United States Patent 10,174,323 (COMPOSITIONS AND METHODS FOR MODULATING ATP2A2 EXPRESSION) - sequence listing, part 2

SEQ ID NO: 33122 - DNA, 15 bp, Homo sapiens
acatgagcacctcaa

SEQ ID NO: 33123 - DNA, 15 bp, Homo sapiens
tacatgagcacctca

SEQ ID NO: 33124 - DNA, 15 bp, Homo sapiens
gtacatgagcacctc

SEQ ID NO: 33125 - DNA, 15 bp, Homo sapiens
ggtacatgagcacct

SEQ ID NO: 33126 - DNA, 15 bp, Homo sapiens
gggtacatgagcacc

SEQ ID NO: 33127 - DNA, 15 bp, Homo sapiens
agggtacatgagcac

SEQ ID NO: 33128 - DNA, 15 bp, Homo sapiens
cagggtacatgagca

SEQ ID NO: 33129 - DNA, 15 bp, Homo sapiens
acagggtacatgagc

SEQ ID NO: 33130 - DNA, 15 bp, Homo sapiens
cacagggtacatgag

SEQ ID NO: 33131 - DNA, 15 bp, Homo sapiens
gcacagggtacatga

SEQ ID NO: 33132 - DNA, 15 bp, Homo sapiens
ggcacagggtacatg

SEQ ID NO: 33133 - DNA, 15 bp, Homo sapiens
gggcacagggtacat

SEQ ID NO: 33134 - DNA, 15 bp, Homo sapiens
agggcacagggtaca

SEQ ID NO: 33135 - DNA, 15 bp, Homo sapiens
aagggcacagggtac

SEQ ID NO: 33136 - DNA, 15 bp, Homo sapiens
gaagggcacagggta

SEQ ID NO: 33137 - DNA, 15 bp, Homo sapiens
ggaagggcacagggt

SEQ ID NO: 33138 - DNA, 15 bp, Homo sapiens
cggaagggcacaggg

SEQ ID NO: 33139 - DNA, 15 bp, Homo sapiens
ccggaagggcacagg

SEQ ID NO: 33140 - DNA, 15 bp, Homo sapiens
tccggaagggcacag

SEQ ID NO: 33141 - DNA, 15 bp, Homo sapiens
ctccggaagggcaca

SEQ ID NO: 33142 - DNA, 15 bp, Homo sapiens
tctccggaagggcac

SEQ ID NO: 33143 - DNA, 15 bp, Homo sapiens
ctctccggaagggca

SEQ ID NO: 33144 - DNA, 15 bp, Homo sapiens
tctctccggaagggc

SEQ ID NO: 33145 - DNA, 15 bp, Homo sapiens
atctctccggaaggg

SEQ ID NO: 33146 - DNA, 15 bp, Homo sapiens
aatctctccggaagg

SEQ ID NO: 33147 - DNA, 15 bp, Homo sapiens
gaatctctccggaag

SEQ ID NO: 33148 - DNA, 15 bp, Homo sapiens
ggaatctctccggaa

SEQ ID NO: 33149 - DNA, 15 bp, Homo sapiens
tggaatctctccgga

SEQ ID NO: 33150 - DNA, 15 bp, Homo sapiens
ctggaatctctccgg

SEQ ID NO: 33151 - DNA, 15 bp, Homo sapiens
gctggaatctctccg

SEQ ID NO: 33152 - DNA, 15 bp, Homo sapiens
tgctggaatctctcc

SEQ ID NO: 33153 - DNA, 15 bp, Homo sapiens
atgctggaatctctc

SEQ ID NO: 33154 - DNA, 15 bp, Homo sapiens
catgctggaatctct

SEQ ID NO: 33155 - DNA, 15 bp, Homo sapiens
gcatgctggaatctc

SEQ ID NO: 33156 - DNA, 15 bp, Homo sapiens
agcatgctggaatct

SEQ ID NO: 33157 - DNA, 15 bp, Homo sapiens
cagcatgctggaatc

SEQ ID NO: 33158 - DNA, 15 bp, Homo sapiens
acagcatgctggaat

SEQ ID NO: 33159 - DNA, 15 bp, Homo sapiens
cacagcatgctggaa

SEQ ID NO: 33160 - DNA, 15 bp, Homo sapiens
gcacagcatgctgga

SEQ ID NO: 33161 - DNA, 15 bp, Homo sapiens
tgcacagcatgctgg

SEQ ID NO: 33162 - DNA, 15 bp, Homo sapiens
gtgcacagcatgctg

SEQ ID NO: 33163 - DNA, 15 bp, Homo sapiens
tgtgcacagcatgct

SEQ ID NO: 33164 - DNA, 15 bp, Homo sapiens
gtgtgcacagcatgc

SEQ ID NO: 33165 - DNA, 15 bp, Homo sapiens
ggtgtgcacagcatg

SEQ ID NO: 33166 - DNA, 15 bp, Homo sapiens
aggtgtgcacagcat

SEQ ID NO: 33167 - DNA, 15 bp, Homo sapiens
caggtgtgcacagca

SEQ ID NO: 33168 - DNA, 15 bp, Homo sapiens
gcaggtgtgcacagc

SEQ ID NO: 33169 - DNA, 15 bp, Homo sapiens
tgcaggtgtgcacag

SEQ ID NO: 33170 - DNA, 15 bp, Homo sapiens
atgcaggtgtgcaca

SEQ ID NO: 33171 - DNA, 15 bp, Homo sapiens
catgcaggtgtgcac

SEQ ID NO: 33172 - DNA, 15 bp, Homo sapiens
acatgcaggtgtgca

SEQ ID NO: 33173 - DNA, 15 bp, Homo sapiens
aacatgcaggtgtgc

SEQ ID NO: 33174 - DNA, 15 bp, Homo sapiens
caacatgcaggtgtg

SEQ ID NO: 33175 - DNA, 15 bp, Homo sapiens
tcaacatgcaggtgt

SEQ ID NO: 33176 - DNA, 15 bp, Homo sapiens
gtcaacatgcaggtg

SEQ ID NO: 33177 - DNA, 15 bp, Homo sapiens
ggtcaacatgcaggt

SEQ ID NO: 33178 - DNA, 15 bp, Homo sapiens
gggtcaacatgcagg

SEQ ID NO: 33179 - DNA, 15 bp, Homo sapiens
agggtcaacatgcag

SEQ ID NO: 33180 - DNA, 15 bp, Homo sapiens
aagggtcaacatgca

SEQ ID NO: 33181 - DNA, 15 bp, Homo sapiens
caagggtcaacatgc

SEQ ID NO: 33182 - DNA, 15 bp, Homo sapiens
acaagggtcaacatg

SEQ ID NO: 33183 - DNA, 15 bp, Homo sapiens
gacaagggtcaacat

SEQ ID NO: 33184 - DNA, 15 bp, Homo sapiens
agacaagggtcaaca

SEQ ID NO: 33185 - DNA, 15 bp, Homo sapiens
aagacaagggtcaac

SEQ ID NO: 33186 - DNA, 15 bp, Homo sapiens
caagacaagggtcaa

SEQ ID NO: 33187 - DNA, 15 bp, Homo sapiens
gcaagacaagggtca

SEQ ID NO: 33188 - DNA, 15 bp, Homo sapiens
ggcaagacaagggtc

SEQ ID NO: 33189 - DNA, 15 bp, Homo sapiens
aggcaagacaagggt

SEQ ID NO: 33190 - DNA, 15 bp, Homo sapiens
aaggcaagacaaggg

SEQ ID NO: 33191 - DNA, 15 bp, Homo sapiens
gaaggcaagacaagg

SEQ ID NO: 33192 - DNA, 15 bp, Homo sapiens
agaaggcaagacaag

SEQ ID NO: 33193 - DNA, 15 bp, Homo sapiens
aagaaggcaagacaa

SEQ ID NO: 33194 - DNA, 15 bp, Homo sapiens
gaagaaggcaagaca

SEQ ID NO: 33195 - DNA, 15 bp, Homo sapiens
ggaagaaggcaagac

SEQ ID NO: 33196 - DNA, 15 bp, Homo sapiens
aggaagaaggcaaga

SEQ ID NO: 33197 - DNA, 15 bp, Homo sapiens
caggaagaaggcaag

SEQ ID NO: 33198 - DNA, 15 bp, Homo sapiens
gcaggaagaaggcaa

SEQ ID NO: 33199 - DNA, 15 bp, Homo sapiens
agcaggaagaaggca

SEQ ID NO: 33200 - DNA, 15 bp, Homo sapiens
aagcaggaagaaggc

SEQ ID NO: 33201 - DNA, 15 bp, Homo sapiens
caagcaggaagaagg

SEQ ID NO: 33202 - DNA, 15 bp, Homo sapiens
acaagcaggaagaag

SEQ ID NO: 33203 - DNA, 15 bp, Homo sapiens
gacaagcaggaagaa

SEQ ID NO: 33204 - DNA, 15 bp, Homo sapiens
tgacaagcaggaaga

SEQ ID NO: 33205 - DNA, 15 bp, Homo sapiens
ctgacaagcaggaag

SEQ ID NO: 33206 - DNA, 15 bp, Homo sapiens
tctgacaagcaggaa

SEQ ID NO: 33207 - DNA, 15 bp, Homo sapiens
atctgacaagcagga

SEQ ID NO: 33208 - DNA, 15 bp, Homo sapiens
gatctgacaagcagg

SEQ ID NO: 33209 - DNA, 15 bp, Homo sapiens
ggatctgacaagcag

SEQ ID NO: 33210 - DNA, 15 bp, Homo sapiens
aggatctgacaagca

SEQ ID NO: 33211 - DNA, 15 bp, Homo sapiens
aaggatctgacaagc

SEQ ID NO: 33212 - DNA, 15 bp, Homo sapiens
gaaggatctgacaag

SEQ ID NO: 33213 - DNA, 15 bp, Homo sapiens
ggaaggatctgacaa

SEQ ID NO: 33214 - DNA, 15 bp, Homo sapiens
tggaaggatctgaca

SEQ ID NO: 33215 - DNA, 15 bp, Homo sapiens
atggaaggatctgac

SEQ ID NO: 33216 - DNA, 15 bp, Homo sapiens
tatggaaggatctga

SEQ ID NO: 33217 - DNA, 15 bp, Homo sapiens
atatggaaggatctg

SEQ ID NO: 33218 - DNA, 15 bp, Homo sapiens
gatatggaaggatct

SEQ ID NO: 33219 - DNA, 15 bp, Homo sapiens
ggatatggaaggatc

SEQ ID NO: 33220 - DNA, 15 bp, Homo sapiens
cggatatggaaggat

SEQ ID NO: 33221 - DNA, 15 bp, Homo sapiens
ccggatatggaagga

SEQ ID NO: 33222 - DNA, 15 bp, Homo sapiens
tccggatatggaagg

SEQ ID NO: 33223 - DNA, 15 bp, Homo sapiens
gtccggatatggaag

SEQ ID NO: 33224 - DNA, 15 bp, Homo sapiens
tgtccggatatggaa

SEQ ID NO: 33225 - DNA, 15 bp, Homo sapiens
atgtccggatatgga

SEQ ID NO: 33226 - DNA, 15 bp, Homo sapiens
catgtccggatatgg

SEQ ID NO: 33227 - DNA, 15 bp, Homo sapiens
gcatgtccggatatg

SEQ ID NO: 33228 - DNA, 15 bp, Homo sapiens
cgcatgtccggatat

SEQ ID NO: 33229 - DNA, 15 bp, Homo sapiens
acgcatgtccggata

SEQ ID NO: 33230 - DNA, 15 bp, Homo sapiens
tacgcatgtccggat

SEQ ID NO: 33231 - DNA, 15 bp, Homo sapiens
ctacgcatgtccgga

SEQ ID NO: 33232 - DNA, 15 bp, Homo sapiens
actacgcatgtccgg

SEQ ID NO: 33233 - DNA, 15 bp, Homo sapiens
cactacgcatgtccg

SEQ ID NO: 33234 - DNA, 15 bp, Homo sapiens
gcactacgcatgtcc

SEQ ID NO: 33235 - DNA, 15 bp, Homo sapiens
ggcactacgcatgtc

SEQ ID NO: 33236 - DNA, 15 bp, Homo sapiens
aggcactacgcatgt

SEQ ID NO: 33237 - DNA, 15 bp, Homo sapiens
gaggcactacgcatg

SEQ ID NO: 33238 - DNA, 15 bp, Homo sapiens
tgaggcactacgcat

SEQ ID NO: 33239 - DNA, 15 bp, Homo sapiens
atgaggcactacgca

SEQ ID NO: 33240 - DNA, 15 bp, Homo sapiens
gatgaggcactacgc

SEQ ID NO: 33241 - DNA, 15 bp, Homo sapiens
ggatgaggcactacg

SEQ ID NO: 33242 - DNA, 15 bp, Homo sapiens
aggatgaggcactac

SEQ ID NO: 33243 - DNA, 15 bp, Homo sapiens
aaggatgaggcacta

SEQ ID NO: 33244 - DNA, 15 bp, Homo sapiens
caaggatgaggcact

SEQ ID NO: 33245 - DNA, 15 bp, Homo sapiens
gcaaggatgaggcac

SEQ ID NO: 33246 - DNA, 15 bp, Homo sapiens
tgcaaggatgaggca

SEQ ID NO: 33247 - DNA, 15 bp, Homo sapiens
ctgcaaggatgaggc

SEQ ID NO: 33248 - DNA, 15 bp, Homo sapiens
gctgcaaggatgagg

SEQ ID NO: 33249 - DNA, 15 bp, Homo sapiens
ggctgcaaggatgag

SEQ ID NO: 33250 - DNA, 15 bp, Homo sapiens
tggctgcaaggatga

SEQ ID NO: 33251 - DNA, 15 bp, Homo sapiens
ctggctgcaaggatg

SEQ ID NO: 33252 - DNA, 15 bp, Homo sapiens
gctggctgcaaggat

SEQ ID NO: 33253 - DNA, 15 bp, Homo sapiens
cgctggctgcaagga

SEQ ID NO: 33254 - DNA, 15 bp, Homo sapiens
ccgctggctgcaagg

SEQ ID NO: 33255 - DNA, 15 bp, Homo sapiens
gccgctggctgcaag

SEQ ID NO: 33256 - DNA, 15 bp, Homo sapiens
ggccgctggctgcaa

SEQ ID NO: 33257 - DNA, 15 bp, Homo sapiens
aggccgctggctgca

SEQ ID NO: 33258 - DNA, 15 bp, Homo sapiens
aaggccgctggctgc

SEQ ID NO: 33259 - DNA, 15 bp, Homo sapiens
gaaggccgctggctg

SEQ ID NO: 33260 - DNA, 15 bp, Homo sapiens
tgaaggccgctggct

SEQ ID NO: 33261 - DNA, 15 bp, Homo sapiens
atgaaggccgctggc

SEQ ID NO: 33262 - DNA, 15 bp, Homo sapiens
catgaaggccgctgg

SEQ ID NO: 33263 - DNA, 15 bp, Homo sapiens
gcatgaaggccgctg

SEQ ID NO: 33264 - DNA, 15 bp, Homo sapiens
agcatgaaggccgct

SEQ ID NO: 33265 - DNA, 15 bp, Homo sapiens
gagcatgaaggccgc

SEQ ID NO: 33266 - DNA, 15 bp, Homo sapiens
ggagcatgaaggccg

SEQ ID NO: 33267 - DNA, 15 bp, Homo sapiens
tggagcatgaaggcc

SEQ ID NO: 33268 - DNA, 15 bp, Homo sapiens
gtggagcatgaaggc

SEQ ID NO: 33269 - DNA, 15 bp, Homo sapiens
agtggagcatgaagg

SEQ ID NO: 33270 - DNA, 15 bp, Homo sapiens
cagtggagcatgaag

SEQ ID NO: 33271 - DNA, 15 bp, Homo sapiens
acagtggagcatgaa

SEQ ID NO: 33272 - DNA, 15 bp, Homo sapiens
tacagtggagcatga

SEQ ID NO: 33273 - DNA, 15 bp, Homo sapiens
ttacagtggagcatg

SEQ ID NO: 33274 - DNA, 15 bp, Homo sapiens
attacagtggagcat

SEQ ID NO: 33275 - DNA, 15 bp, Homo sapiens
aattacagtggagca

SEQ ID NO: 33276 - DNA, 15 bp, Homo sapiens
gaattacagtggagc

SEQ ID NO: 33277 - DNA, 15 bp, Homo sapiens
cgaattacagtggag

SEQ ID NO: 33278 - DNA, 15 bp, Homo sapiens
acgaattacagtgga

SEQ ID NO: 33279 - DNA, 15 bp, Homo sapiens
cacgaattacagtgg

SEQ ID NO: 33280 - DNA, 15 bp, Homo sapiens
ccacgaattacagtg

SEQ ID NO: 33281 - DNA, 15 bp, Homo sapiens
cccacgaattacagt

SEQ ID NO: 33282 - DNA, 15 bp, Homo sapiens
acccacgaattacag

SEQ ID NO: 33283 - DNA, 15 bp, Homo sapiens
aacccacgaattaca

SEQ ID NO: 33284 - DNA, 15 bp, Homo sapiens
taacccacgaattac

SEQ ID NO: 33285 - DNA, 15 bp, Homo sapiens
ctaacccacgaatta

SEQ ID NO: 33286 - DNA, 15 bp, Homo sapiens
actaacccacgaatt

SEQ ID NO: 33287 - DNA, 15 bp, Homo sapiens
cactaacccacgaat

SEQ ID NO: 33288 - DNA, 15 bp, Homo sapiens
ccactaacccacgaa

SEQ ID NO: 33289 - DNA, 15 bp, Homo sapiens
cccactaacccacga

SEQ ID NO: 33290 - DNA, 15 bp, Homo sapiens
acccactaacccacg

SEQ ID NO: 33291 - DNA, 15 bp, Homo sapiens
tacccactaacccac

SEQ ID NO: 33292 - DNA, 15 bp, Homo sapiens
atacccactaaccca

SEQ ID NO: 33293 - DNA, 15 bp, Homo sapiens
tatacccactaaccc

SEQ ID NO: 33294 - DNA, 15 bp, Homo sapiens
atatacccactaacc

SEQ ID NO: 33295 - DNA, 15 bp, Homo sapiens
catatacccactaac

SEQ ID NO: 33296 - DNA, 15 bp, Homo sapiens
gcatatacccactaa

SEQ ID NO: 33297 - DNA, 15 bp, Homo sapiens
tgcatatacccacta

SEQ ID NO: 33298 - DNA, 15 bp, Homo sapiens
gtgcatatacccact

SEQ ID NO: 33299 - DNA, 15 bp, Homo sapiens
agtgcatatacccac

SEQ ID NO: 33300 - DNA, 15 bp, Homo sapiens
aagtgcatataccca

SEQ ID NO: 33301 - DNA, 15 bp, Homo sapiens
caagtgcatataccc

SEQ ID NO: 33302 - DNA, 15 bp, Homo sapiens
acaagtgcatatacc

SEQ ID NO: 33303 - DNA, 15 bp, Homo sapiens
aacaagtgcatatac

SEQ ID NO: 33304 - DNA, 15 bp, Homo sapiens
caacaagtgcatata

SEQ ID NO: 33305 - DNA, 15 bp, Homo sapiens
acaacaagtgcatat

SEQ ID NO: 33306 - DNA, 15 bp, Homo sapiens
aacaacaagtgcata

SEQ ID NO: 33307 - DNA, 15 bp, Homo sapiens
aaacaacaagtgcat

SEQ ID NO: 33308 - DNA, 15 bp, Homo sapiens
aaaacaacaagtgca

SEQ ID NO: 33309 - DNA, 15 bp, Homo sapiens
aaaaacaacaagtgc

SEQ ID NO: 33310 - DNA, 15 bp, Homo sapiens
caaaaacaacaagtg

SEQ ID NO: 33311 - DNA, 15 bp, Homo sapiens
tcaaaaacaacaagt

SEQ ID NO: 33312 - DNA, 15 bp, Homo sapiens
atcaaaaacaacaag

SEQ ID NO: 33313 - DNA, 15 bp, Homo sapiens
catcaaaaacaacaa

SEQ ID NO: 33314 - DNA, 15 bp, Homo sapiens
gcatcaaaaacaaca

SEQ ID NO: 33315 - DNA, 15 bp, Homo sapiens
agcatcaaaaacaac

SEQ ID NO: 33316 - DNA, 15 bp, Homo sapiens
tagcatcaaaaacaa

SEQ ID NO: 33317 - DNA, 15 bp, Homo sapiens
gtagcatcaaaaaca

SEQ ID NO: 33318 - DNA, 15 bp, Homo sapiens
ggtagcatcaaaaac

SEQ ID NO: 33319 - DNA, 15 bp, Homo sapiens
tggtagcatcaaaaa

SEQ ID NO: 33320 - DNA, 15 bp, Homo sapiens
gtggtagcatcaaaa

SEQ ID NO: 33321 - DNA, 15 bp, Homo sapiens
tgtggtagcatcaaa

SEQ ID NO: 33322 - DNA, 15 bp, Homo sapiens
atgtggtagcatcaa

SEQ ID NO: 33323 - DNA, 15 bp, Homo sapiens
catgtggtagcatca

SEQ ID NO: 33324 - DNA, 15 bp, Homo sapiens
ccatgtggtagcatc

SEQ ID NO: 33325 - DNA, 15 bp, Homo sapiens
cccatgtggtagcat

SEQ ID NO: 33326 - DNA, 15 bp, Homo sapiens
ccccatgtggtagca

SEQ ID NO: 33327 - DNA, 15 bp, Homo sapiens
tccccatgtggtagc

SEQ ID NO: 33328 - DNA, 15 bp, Homo sapiens
atccccatgtggtag

SEQ ID NO: 33329 - DNA, 15 bp, Homo sapiens
tatccccatgtggta

SEQ ID NO: 33330 - DNA, 15 bp, Homo sapiens
atatccccatgtggt

SEQ ID NO: 33331 - DNA, 15 bp, Homo sapiens
aatatccccatgtgg

SEQ ID NO: 33332 - DNA, 15 bp, Homo sapiens
aaatatccccatgtg

SEQ ID NO: 33333 - DNA, 15 bp, Homo sapiens
caaatatccccatgt

SEQ ID NO: 33334 - DNA, 15 bp, Homo sapiens
gcaaatatccccatg

SEQ ID NO: 33335 - DNA, 15 bp, Homo sapiens
ggcaaatatccccat

SEQ ID NO: 33336 - DNA, 15 bp, Homo sapiens
aggcaaatatcccca

SEQ ID NO: 33337 - DNA, 15 bp, Homo sapiens
gaggcaaatatcccc

SEQ ID NO: 33338 - DNA, 15 bp, Homo sapiens
cgaggcaaatatccc

SEQ ID NO: 33339 - DNA, 15 bp, Homo sapiens
acgaggcaaatatcc

SEQ ID NO: 33340 - DNA, 15 bp, Homo sapiens
gacgaggcaaatatc

SEQ ID NO: 33341 - DNA, 15 bp, Homo sapiens
agacgaggcaaatat

SEQ ID NO: 33342 - DNA, 15 bp, Homo sapiens
cagacgaggcaaata

SEQ ID NO: 33343 - DNA, 15 bp, Homo sapiens
tcagacgaggcaaat

SEQ ID NO: 33344 - DNA, 15 bp, Homo sapiens
ttcagacgaggcaaa

SEQ ID NO: 33345 - DNA, 15 bp, Homo sapiens
gttcagacgaggcaa

SEQ ID NO: 33346 - DNA, 15 bp, Homo sapiens
agttcagacgaggca

SEQ ID NO: 33347 - DNA, 15 bp, Homo sapiens
gagttcagacgaggc

SEQ ID NO: 33348 - DNA, 15 bp, Homo sapiens
agagttcagacgagg

SEQ ID NO: 33349 - DNA, 15 bp, Homo sapiens
cagagttcagacgag

SEQ ID NO: 33350 - DNA, 15 bp, Homo sapiens
acagagttcagacga

SEQ ID NO: 33351 - DNA, 15 bp, Homo sapiens
cacagagttcagacg

SEQ ID NO: 33352 - DNA, 15 bp, Homo sapiens
acacagagttcagac

SEQ ID NO: 33353 - DNA, 15 bp, Homo sapiens
tacacagagttcaga

SEQ ID NO: 33354 - DNA, 15 bp, Homo sapiens
atacacagagttcag

SEQ ID NO: 33355 - DNA, 15 bp, Homo sapiens
aatacacagagttca

SEQ ID NO: 33356 - DNA, 15 bp, Homo sapiens
gaatacacagagttc

SEQ ID NO: 33357 - DNA, 15 bp, Homo sapiens
agaatacacagagtt

SEQ ID NO: 33358 - DNA, 15 bp, Homo sapiens
gagaatacacagagt

SEQ ID NO: 33359 - DNA, 15 bp, Homo sapiens
agagaatacacagag

SEQ ID NO: 33360 - DNA, 15 bp, Homo sapiens
cagagaatacacaga

SEQ ID NO: 33361 - DNA, 15 bp, Homo sapiens
gcagagaatacacag

SEQ ID NO: 33362 - DNA, 15 bp, Homo sapiens
agcagagaatacaca

SEQ ID NO: 33363 - DNA, 15 bp, Homo sapiens
cagcagagaatacac

SEQ ID NO: 33364 - DNA, 15 bp, Homo sapiens
gcagcagagaataca

SEQ ID NO: 33365 - DNA, 15 bp, Homo sapiens
tgcagcagagaatac

SEQ ID NO: 33366 - DNA, 15 bp, Homo sapiens
gtgcagcagagaata

SEQ ID NO: 33367 - DNA, 15 bp, Homo sapiens
ggtgcagcagagaat

SEQ ID NO: 33368 - DNA, 15 bp, Homo sapiens
aggtgcagcagagaa

SEQ ID NO: 33369 - DNA, 15 bp, Homo sapiens
aaggtgcagcagaga

SEQ ID NO: 33370 - DNA, 15 bp, Homo sapiens
caaggtgcagcagag

SEQ ID NO: 33371 - DNA, 15 bp, Homo sapiens
acaaggtgcagcaga

SEQ ID NO: 33372 - DNA, 15 bp, Homo sapiens
aacaaggtgcagcag

SEQ ID NO: 33373 - DNA, 15 bp, Homo sapiens
caacaaggtgcagca

SEQ ID NO: 33374 - DNA, 15 bp, Homo sapiens
gcaacaaggtgcagc

SEQ ID NO: 33375 - DNA, 15 bp, Homo sapiens
agcaacaaggtgcag

SEQ ID NO: 33376 - DNA, 15 bp, Homo sapiens
aagcaacaaggtgca

SEQ ID NO: 33377 - DNA, 15 bp, Homo sapiens
gaagcaacaaggtgc

SEQ ID NO: 33378 - DNA, 15 bp, Homo sapiens
agaagcaacaaggtg

SEQ ID NO: 33379 - DNA, 15 bp, Homo sapiens
aagaagcaacaaggt

SEQ ID NO: 33380 - DNA, 15 bp, Homo sapiens
aaagaagcaacaagg

SEQ ID NO: 33381 - DNA, 15 bp, Homo sapiens
caaagaagcaacaag

SEQ ID NO: 33382 - DNA, 15 bp, Homo sapiens
gcaaagaagcaacaa

SEQ ID NO: 33383 - DNA, 15 bp, Homo sapiens
tgcaaagaagcaaca

SEQ ID NO: 33384 - DNA, 15 bp, Homo sapiens
ttgcaaagaagcaac

SEQ ID NO: 33385 - DNA, 15 bp, Homo sapiens
attgcaaagaagcaa

SEQ ID NO: 33386 - DNA, 15 bp, Homo sapiens
tattgcaaagaagca

SEQ ID NO: 33387 - DNA, 15 bp, Homo sapiens
ttattgcaaagaagc

SEQ ID NO: 33388 - DNA, 15 bp, Homo sapiens
tttattgcaaagaag

SEQ ID NO: 33389 - DNA, 15 bp, Homo sapiens
gtttattgcaaagaa

SEQ ID NO: 33390 - DNA, 15 bp, Homo sapiens
agtttattgcaaaga

SEQ ID NO: 33391 - DNA, 15 bp, Homo sapiens
aagtttattgcaaag

SEQ ID NO: 33392 - DNA, 15 bp, Homo sapiens
gaagtttattgcaaa

SEQ ID NO: 33393 - DNA, 15 bp, Homo sapiens
ggaagtttattgcaa

SEQ ID NO: 33394 - DNA, 15 bp, Homo sapiens
aggaagtttattgca

SEQ ID NO: 33395 - DNA, 15 bp, Homo sapiens
caggaagtttattgc

SEQ ID NO: 33396 - DNA, 15 bp, Homo sapiens
tcaggaagtttattg

SEQ ID NO: 33397 - DNA, 15 bp, Homo sapiens
ttcaggaagtttatt

SEQ ID NO: 33398 - DNA, 15 bp, Homo sapiens
gttcaggaagtttat

SEQ ID NO: 33399 - DNA, 15 bp, Homo sapiens
agttcaggaagttta

SEQ ID NO: 33400 - DNA, 15 bp, Homo sapiens
gagttcaggaagttt

SEQ ID NO: 33401 - DNA, 15 bp, Homo sapiens
tgagttcaggaagtt

SEQ ID NO: 33402 - DNA, 15 bp, Homo sapiens
ttgagttcaggaagt

SEQ ID NO: 33403 - DNA, 15 bp, Homo sapiens
tttgagttcaggaag

SEQ ID NO: 33404 - DNA, 15 bp, Homo sapiens
ctttgagttcaggaa

SEQ ID NO: 33405 - DNA, 15 bp, Homo sapiens
gctttgagttcagga

SEQ ID NO: 33406 - DNA, 15 bp, Homo sapiens
agctttgagttcagg

SEQ ID NO: 33407 - DNA, 15 bp, Homo sapiens
tagctttgagttcag

SEQ ID NO: 33408 - DNA, 15 bp, Homo sapiens
ttagctttgagttca

SEQ ID NO: 33409 - DNA, 15 bp, Homo sapiens
attagctttgagttc

SEQ ID NO: 33410 - DNA, 15 bp, Homo sapiens
tattagctttgagtt

SEQ ID NO: 33411 - DNA, 15 bp, Homo sapiens
gtattagctttgagt

SEQ ID NO: 33412 - DNA, 15 bp, Homo sapiens
agtattagctttgag

SEQ ID NO: 33413 - DNA, 15 bp, Homo sapiens
cagtattagctttga

SEQ ID NO: 33414 - DNA, 15 bp, Homo sapiens
ccagtattagctttg

SEQ ID NO: 33415 - DNA, 15 bp, Homo sapiens
cccagtattagcttt

SEQ ID NO: 33416 - DNA, 15 bp, Homo sapiens
ccccagtattagctt

SEQ ID NO: 33417 - DNA, 15 bp, Homo sapiens
cccccagtattagct

SEQ ID NO: 33418 - DNA, 15 bp, Homo sapiens
ccccccagtattagc

SEQ ID NO: 33419 - DNA, 15 bp, Homo sapiens
tccccccagtattag

SEQ ID NO: 33420 - DNA, 15 bp, Homo sapiens
ttccccccagtatta

SEQ ID NO: 33421 - DNA, 15 bp, Homo sapiens
attccccccagtatt

SEQ ID NO: 33422 - DNA, 15 bp, Homo sapiens
gattccccccagtat

SEQ ID NO: 33423 - DNA, 15 bp, Homo sapiens
ggattccccccagta

SEQ ID NO: 33424 - DNA, 15 bp, Homo sapiens
gggattccccccagt

SEQ ID NO: 33425 - DNA, 15 bp, Homo sapiens
tgggattccccccag

SEQ ID NO: 33426 - DNA, 15 bp, Homo sapiens
ctgggattcccccca

SEQ ID NO: 33427 - DNA, 15 bp, Homo sapiens
tctgggattcccccc

SEQ ID NO: 33428 - DNA, 15 bp, Homo sapiens
ttctgggattccccc

SEQ ID NO: 33429 - DNA, 15 bp, Homo sapiens
cttctgggattcccc

SEQ ID NO: 33430 - DNA, 15 bp, Homo sapiens
gcttctgggattccc

SEQ ID NO: 33431 - DNA, 15 bp, Homo sapiens
agcttctgggattcc

SEQ ID NO: 33432 - DNA, 15 bp, Homo sapiens
cagcttctgggattc

SEQ ID NO: 33433 - DNA, 15 bp, Homo sapiens
gcagcttctgggatt

SEQ ID NO: 33434 - DNA, 15 bp, Homo sapiens
agcagcttctgggat

SEQ ID NO: 33435 - DNA, 15 bp, Homo sapiens
cagcagcttctggga

SEQ ID NO: 33436 - DNA, 15 bp, Homo sapiens
tcagcagcttctggg

SEQ ID NO: 33437 - DNA, 15 bp, Homo sapiens
ctcagcagcttctgg

SEQ ID NO: 33438 - DNA, 15 bp, Homo sapiens
cctcagcagcttctg

SEQ ID NO: 33439 - DNA, 15 bp, Homo sapiens
ccctcagcagcttct

SEQ ID NO: 33440 - DNA, 15 bp, Homo sapiens
gccctcagcagcttc

SEQ ID NO: 33441 - DNA, 15 bp, Homo sapiens
tgccctcagcagctt

SEQ ID NO: 33442 - DNA, 15 bp, Homo sapiens
ctgccctcagcagct

SEQ ID NO: 33443 - DNA, 15 bp, Homo sapiens
cctgccctcagcagc

SEQ ID NO: 33444 - DNA, 15 bp, Homo sapiens
ccctgccctcagcag

SEQ ID NO: 33445 - DNA, 15 bp, Homo sapiens
gccctgccctcagca

SEQ ID NO: 33446 - DNA, 15 bp, Homo sapiens
ggccctgccctcagc

SEQ ID NO: 33447 - DNA, 15 bp, Homo sapiens
tggccctgccctcag

SEQ ID NO: 33448 - DNA, 15 bp, Homo sapiens
atggccctgccctca

SEQ ID NO: 33449 - DNA, 15 bp, Homo sapiens
catggccctgccctc

SEQ ID NO: 33450 - DNA, 15 bp, Homo sapiens
gcatggccctgccct

SEQ ID NO: 33451 - DNA, 15 bp, Homo sapiens
agcatggccctgccc

SEQ ID NO: 33452 - DNA, 15 bp, Homo sapiens
cagcatggccctgcc

SEQ ID NO: 33453 - DNA, 15 bp, Homo sapiens
gcagcatggccctgc

SEQ ID NO: 33454 - DNA, 15 bp, Homo sapiens
agcagcatggccctg

SEQ ID NO: 33455 - DNA, 15 bp, Homo sapiens
gagcagcatggccct

SEQ ID NO: 33456 - DNA, 15 bp, Homo sapiens
tgagcagcatggccc

SEQ ID NO: 33457 - DNA, 15 bp, Homo sapiens
ctgagcagcatggcc

SEQ ID NO: 33458 - DNA, 15 bp, Homo sapiens
actgagcagcatggc

SEQ ID NO: 33459 - DNA, 15 bp, Homo sapiens
cactgagcagcatgg

SEQ ID NO: 33460 - DNA, 15 bp, Homo sapiens
acactgagcagcatg

SEQ ID NO: 33461 - DNA, 15 bp, Homo sapiens
aacactgagcagcat

SEQ ID NO: 33462 - DNA, 15 bp, Homo sapiens
gaacactgagcagca

SEQ ID NO: 33463 - DNA, 15 bp, Homo sapiens
ggaacactgagcagc

SEQ ID NO: 33464 - DNA, 15 bp, Homo sapiens
tggaacactgagcag

SEQ ID NO: 33465 - DNA, 15 bp, Homo sapiens
gtggaacactgagca

SEQ ID NO: 33466 - DNA, 15 bp, Homo sapiens
ggtggaacactgagc

SEQ ID NO: 33467 - DNA, 15 bp, Homo sapiens
gggtggaacactgag

SEQ ID NO: 33468 - DNA, 15 bp, Homo sapiens
agggtggaacactga

SEQ ID NO: 33469 - DNA, 15 bp, Homo sapiens
tagggtggaacactg

SEQ ID NO: 33470 - DNA, 15 bp, Homo sapiens
ctagggtggaacact

SEQ ID NO: 33471 - DNA, 15 bp, Homo sapiens
gctagggtggaacac

SEQ ID NO: 33472 - DNA, 15 bp, Homo sapiens
agctagggtggaaca

SEQ ID NO: 33473 - DNA, 15 bp, Homo sapiens
gagctagggtggaac

SEQ ID NO: 33474 - DNA, 15 bp, Homo sapiens
ggagctagggtggaa

SEQ ID NO: 33475 - DNA, 15 bp, Homo sapiens
aggagctagggtgga

SEQ ID NO: 33476 - DNA, 15 bp, Homo sapiens
caggagctagggtgg

SEQ ID NO: 33477 - DNA, 15 bp, Homo sapiens
tcaggagctagggtg

SEQ ID NO: 33478 - DNA, 15 bp, Homo sapiens
gtcaggagctagggt

SEQ ID NO: 33479 - DNA, 15 bp, Homo sapiens
tgtcaggagctaggg

SEQ ID NO: 33480 - DNA, 15 bp, Homo sapiens
ctgtcaggagctagg

SEQ ID NO: 33481 - DNA, 15 bp, Homo sapiens
gctgtcaggagctag

SEQ ID NO: 33482 - DNA, 15 bp, Homo sapiens
tgctgtcaggagcta

SEQ ID NO: 33483 - DNA, 15 bp, Homo sapiens
atgctgtcaggagct

SEQ ID NO: 33484 - DNA, 15 bp, Homo sapiens
aatgctgtcaggagc

SEQ ID NO: 33485 - DNA, 15 bp, Homo sapiens
aaatgctgtcaggag

SEQ ID NO: 33486 - DNA, 15 bp, Homo sapiens
gaaatgctgtcagga

SEQ ID NO: 33487 - DNA, 15 bp, Homo sapiens
ggaaatgctgtcagg

SEQ ID NO: 33488 - DNA, 15 bp, Homo sapiens
gggaaatgctgtcag

SEQ ID NO: 33489 - DNA, 15 bp, Homo sapiens
agggaaatgctgtca

SEQ ID NO: 33490 - DNA, 15 bp, Homo sapiens
tagggaaatgctgtc

SEQ ID NO: 33491 - DNA, 15 bp, Homo sapiens
ctagggaaatgctgt

SEQ ID NO: 33492 - DNA, 15 bp, Homo sapiens
tctagggaaatgctg

SEQ ID NO: 33493 - DNA, 15 bp, Homo sapiens
ttctagggaaatgct

SEQ ID NO: 33494 - DNA, 15 bp, Homo sapiens
tttctagggaaatgc

SEQ ID NO: 33495 - DNA, 15 bp, Homo sapiens
ttttctagggaaatg

SEQ ID NO: 33496 - DNA, 15 bp, Homo sapiens
gttttctagggaaat

SEQ ID NO: 33497 - DNA, 15 bp, Homo sapiens
agttttctagggaaa

SEQ ID NO: 33498 - DNA, 15 bp, Homo sapiens
cagttttctagggaa

SEQ ID NO: 33499 - DNA, 15 bp, Homo sapiens
gcagttttctaggga

SEQ ID NO: 33500 - DNA, 15 bp, Homo sapiens
agcagttttctaggg

SEQ ID NO: 33501 - DNA, 15 bp, Homo sapiens
cagcagttttctagg

SEQ ID NO: 33502 - DNA, 15 bp, Homo sapiens
gcagcagttttctag

SEQ ID NO: 33503 - DNA, 15 bp, Homo sapiens
agcagcagttttcta

SEQ ID NO: 33504 - DNA, 15 bp, Homo sapiens
cagcagcagttttct

SEQ ID NO: 33505 - DNA, 15 bp, Homo sapiens
ccagcagcagttttc

SEQ ID NO: 33506 - DNA, 15 bp, Homo sapiens
cccagcagcagtttt

SEQ ID NO: 33507 - DNA, 15 bp, Homo sapiens
gcccagcagcagttt

SEQ ID NO: 33508 - DNA, 15 bp, Homo sapiens
ggcccagcagcagtt

SEQ ID NO: 33509 - DNA, 15 bp, Homo sapiens
aggcccagcagcagt

SEQ ID NO: 33510 - DNA, 15 bp, Homo sapiens
gaggcccagcagcag

SEQ ID NO: 33511 - DNA, 15 bp, Homo sapiens
agaggcccagcagca

SEQ ID NO: 33512 - DNA, 15 bp, Homo sapiens
tagaggcccagcagc

SEQ ID NO: 33513 - DNA, 15 bp, Homo sapiens
ttagaggcccagcag

SEQ ID NO: 33514 - DNA, 15 bp, Homo sapiens
attagaggcccagca

SEQ ID NO: 33515 - DNA, 15 bp, Homo sapiens
cattagaggcccagc

SEQ ID NO: 33516 - DNA, 15 bp, Homo sapiens
ccattagaggcccag

SEQ ID NO: 33517 - DNA, 15 bp, Homo sapiens
tccattagaggccca

SEQ ID NO: 33518 - DNA, 15 bp, Homo sapiens
ctccattagaggccc

SEQ ID NO: 33519 - DNA, 15 bp, Homo sapiens
gctccattagaggcc

SEQ ID NO: 33520 - DNA, 15 bp, Homo sapiens
tgctccattagaggc

SEQ ID NO: 33521 - DNA, 15 bp, Homo sapiens
ttgctccattagagg

SEQ ID NO: 33522 - DNA, 15 bp, Homo sapiens
tttgctccattagag

SEQ ID NO: 33523 - DNA, 15 bp, Homo sapiens
atttgctccattaga

SEQ ID NO: 33524 - DNA, 15 bp, Homo sapiens
tatttgctccattag

SEQ ID NO: 33525 - DNA, 15 bp, Homo sapiens
ttatttgctccatta

SEQ ID NO: 33526 - DNA, 15 bp, Homo sapiens
tttatttgctccatt

SEQ ID NO: 33527 - DNA, 15 bp, Homo sapiens
atttatttgctccat

SEQ ID NO: 33528 - DNA, 15 bp, Homo sapiens
gatttatttgctcca

SEQ ID NO: 33529 - DNA, 15 bp, Homo sapiens
agatttatttgctcc

SEQ ID NO: 33530 - DNA, 15 bp, Homo sapiens
cagatttatttgctc

SEQ ID NO: 33531 - DNA, 15 bp, Homo sapiens
acagatttatttgct

SEQ ID NO: 33532 - DNA, 15 bp, Homo sapiens
cacagatttatttgc

SEQ ID NO: 33533 - DNA, 15 bp, Homo sapiens
acacagatttatttg

SEQ ID NO: 33534 - DNA, 15 bp, Homo sapiens
tacacagatttattt

SEQ ID NO: 33535 - DNA, 15 bp, Homo sapiens
gtacacagatttatt

SEQ ID NO: 33536 - DNA, 15 bp, Homo sapiens
tgtacacagatttat

SEQ ID NO: 33537 - DNA, 15 bp, Homo sapiens
ttgtacacagattta

SEQ ID NO: 33538 - DNA, 15 bp, Homo sapiens
gttgtacacagattt

SEQ ID NO: 33539 - DNA, 15 bp, Homo sapiens
agttgtacacagatt

SEQ ID NO: 33540 - DNA, 15 bp, Homo sapiens
tagttgtacacagat

SEQ ID NO: 33541 - DNA, 15 bp, Homo sapiens
ctagttgtacacaga

SEQ ID NO: 33542 - DNA, 15 bp, Homo sapiens
cctagttgtacacag

SEQ ID NO: 33543 - DNA, 15 bp, Homo sapiens
gcctagttgtacaca

SEQ ID NO: 33544 - DNA, 15 bp, Homo sapiens
tgcctagttgtacac

SEQ ID NO: 33545 - DNA, 15 bp, Homo sapiens
ctgcctagttgtaca

SEQ ID NO: 33546 - DNA, 15 bp, Homo sapiens
gctgcctagttgtac

SEQ ID NO: 33547 - DNA, 15 bp, Homo sapiens
tgctgcctagttgta

SEQ ID NO: 33548 - DNA, 15 bp, Homo sapiens
ttgctgcctagttgt

SEQ ID NO: 33549 - DNA, 15 bp, Homo sapiens
attgctgcctagttg

SEQ ID NO: 33550 - DNA, 15 bp, Homo sapiens
tattgctgcctagtt

SEQ ID NO: 33551 - DNA, 15 bp, Homo sapiens
ctattgctgcctagt

SEQ ID NO: 33552 - DNA, 15 bp, Homo sapiens
actattgctgcctag

SEQ ID NO: 33553 - DNA, 15 bp, Homo sapiens
aactattgctgccta

SEQ ID NO: 33554 - DNA, 15 bp, Homo sapiens
aaactattgctgcct

SEQ ID NO: 33555 - DNA, 15 bp, Homo sapiens
caaactattgctgcc

SEQ ID NO: 33556 - DNA, 15 bp, Homo sapiens
acaaactattgctgc

SEQ ID NO: 33557 - DNA, 15 bp, Homo sapiens
gacaaactattgctg

SEQ ID NO: 33558 - DNA, 15 bp, Homo sapiens
ggacaaactattgct

SEQ ID NO: 33559 - DNA, 15 bp, Homo sapiens
tggacaaactattgc

SEQ ID NO: 33560 - DNA, 15 bp, Homo sapiens
ttggacaaactattg

SEQ ID NO: 33561 - DNA, 15 bp, Homo sapiens
tttggacaaactatt

SEQ ID NO: 33562 - DNA, 15 bp, Homo sapiens
ttttggacaaactat

SEQ ID NO: 33563 - DNA, 15 bp, Homo sapiens
cttttggacaaacta

SEQ ID NO: 33564 - DNA, 15 bp, Homo sapiens
acttttggacaaact

SEQ ID NO: 33565 - DNA, 15 bp, Homo sapiens
gacttttggacaaac

SEQ ID NO: 33566 - DNA, 15 bp, Homo sapiens
ggacttttggacaaa

SEQ ID NO: 33567 - DNA, 15 bp, Homo sapiens
aggacttttggacaa

SEQ ID NO: 33568 - DNA, 15 bp, Homo sapiens
caggacttttggaca

SEQ ID NO: 33569 - DNA, 15 bp, Homo sapiens
ccaggacttttggac

SEQ ID NO: 33570 - DNA, 15 bp, Homo sapiens
accaggacttttgga

SEQ ID NO: 33571 - DNA, 15 bp, Homo sapiens
caccaggacttttgg

SEQ ID NO: 33572 - DNA, 15 bp, Homo sapiens
acaccaggacttttg

SEQ ID NO: 33573 - DNA, 15 bp, Homo sapiens
tacaccaggactttt

SEQ ID NO: 33574 - DNA, 15 bp, Homo sapiens
ttacaccaggacttt

SEQ ID NO: 33575 - DNA, 15 bp, Homo sapiens
attacaccaggactt

SEQ ID NO: 33576 - DNA, 15 bp, Homo sapiens
gattacaccaggact

SEQ ID NO: 33577 - DNA, 15 bp, Homo sapiens
agattacaccaggac

SEQ ID NO: 33578 - DNA, 15 bp, Homo sapiens
tagattacaccagga

SEQ ID NO: 33579 - DNA, 15 bp, Homo sapiens
ctagattacaccagg

SEQ ID NO: 33580 - DNA, 15 bp, Homo sapiens
actagattacaccag

SEQ ID NO: 33581 - DNA, 15 bp, Homo sapiens
gactagattacacca

SEQ ID NO: 33582 - DNA, 15 bp, Homo sapiens
ggactagattacacc

SEQ ID NO: 33583 - DNA, 15 bp, Homo sapiens
gggactagattacac

SEQ ID NO: 33584 - DNA, 15 bp, Homo sapiens
agggactagattaca

SEQ ID NO: 33585 - DNA, 15 bp, Homo sapiens
gagggactagattac

SEQ ID NO: 33586 - DNA, 15 bp, Homo sapiens
tgagggactagatta

SEQ ID NO: 33587 - DNA, 15 bp, Homo sapiens
ttgagggactagatt

SEQ ID NO: 33588 - DNA, 15 bp, Homo sapiens
tttgagggactagat

SEQ ID NO: 33589 - DNA, 15 bp, Homo sapiens
gtttgagggactaga

SEQ ID NO: 33590 - DNA, 15 bp, Homo sapiens
agtttgagggactag

SEQ ID NO: 33591 - DNA, 15 bp, Homo sapiens
cagtttgagggacta

SEQ ID NO: 33592 - DNA, 15 bp, Homo sapiens
acagtttgagggact

SEQ ID NO: 33593 - DNA, 15 bp, Homo sapiens
cacagtttgagggac

SEQ ID NO: 33594 - DNA, 15 bp, Homo sapiens
gcacagtttgaggga

SEQ ID NO: 33595 - DNA, 15 bp, Homo sapiens
tgcacagtttgaggg

SEQ ID NO: 33596 - DNA, 15 bp, Homo sapiens
ctgcacagtttgagg

SEQ ID NO: 33597 - DNA, 15 bp, Homo sapiens
gctgcacagtttgag

SEQ ID NO: 33598 - DNA, 15 bp, Homo sapiens
ggctgcacagtttga

SEQ ID NO: 33599 - DNA, 15 bp, Homo sapiens
aggctgcacagtttg

SEQ ID NO: 33600 - DNA, 15 bp, Homo sapiens
aaggctgcacagttt

SEQ ID NO: 33601 - DNA, 15 bp, Homo sapiens
taaggctgcacagtt

SEQ ID NO: 33602 - DNA, 15 bp, Homo sapiens
gtaaggctgcacagt

SEQ ID NO: 33603 - DNA, 15 bp, Homo sapiens
tgtaaggctgcacag

SEQ ID NO: 33604 - DNA, 15 bp, Homo sapiens
atgtaaggctgcaca

SEQ ID NO: 33605 - DNA, 15 bp, Homo sapiens
catgtaaggctgcac

SEQ ID NO: 33606 - DNA, 15 bp, Homo sapiens
ccatgtaaggctgca

SEQ ID NO: 33607 - DNA, 15 bp, Homo sapiens
tccatgtaaggctgc

SEQ ID NO: 33608 - DNA, 15 bp, Homo sapiens
ctccatgtaaggctg

SEQ ID NO: 33609 - DNA, 15 bp, Homo sapiens
actccatgtaaggct

SEQ ID NO: 33610 - DNA, 15 bp, Homo sapiens
tactccatgtaaggc

SEQ ID NO: 33611 - DNA, 15 bp, Homo sapiens
gtactccatgtaagg

SEQ ID NO: 33612 - DNA, 15 bp, Homo sapiens
tgtactccatgtaag

SEQ ID NO: 33613 - DNA, 15 bp, Homo sapiens
gtgtactccatgtaa

SEQ ID NO: 33614 - DNA, 15 bp, Homo sapiens
tgtgtactccatgta

SEQ ID NO: 33615 - DNA, 15 bp, Homo sapiens
gtgtgtactccatgt

SEQ ID NO: 33616 - DNA, 15 bp, Homo sapiens
tgtgtgtactccatg

SEQ ID NO: 33617 - DNA, 15 bp, Homo sapiens
gtgtgtgtactccat

SEQ ID NO: 33618 - DNA, 15 bp, Homo sapiens
tgtgtgtgtactcca

SEQ ID NO: 33619 - DNA, 15 bp, Homo sapiens
gtgtgtgtgtactcc

SEQ ID NO: 33620 - DNA, 15 bp, Homo sapiens
agtgtgtgtgtactc

SEQ ID NO: 33621 - DNA, 15 bp, Homo sapiens
aagtgtgtgtgtact

SEQ ID NO: 33622 - DNA, 15 bp, Homo sapiens
caagtgtgtgtgtac

SEQ ID NO: 33623 - DNA, 15 bp, Homo sapiens
gcaagtgtgtgtgta

SEQ ID NO: 33624 - DNA, 15 bp, Homo sapiens
tgcaagtgtgtgtgt

SEQ ID NO: 33625 - DNA, 15 bp, Homo sapiens
ctgcaagtgtgtgtg

SEQ ID NO: 33626 - DNA, 15 bp, Homo sapiens
gctgcaagtgtgtgt

SEQ ID NO: 33627 - DNA, 15 bp, Homo sapiens
ggctgcaagtgtgtg

SEQ ID NO: 33628 - DNA, 15 bp, Homo sapiens
aggctgcaagtgtgt

SEQ ID NO: 33629 - DNA, 15 bp, Homo sapiens
aaggctgcaagtgtg

SEQ ID NO: 33630 - DNA, 15 bp, Homo sapiens
caaggctgcaagtgt

SEQ ID NO: 33631 - DNA, 15 bp, Homo sapiens
tcaaggctgcaagtg

SEQ ID NO: 33632 - DNA, 15 bp, Homo sapiens
ttcaaggctgcaagt

SEQ ID NO: 33633 - DNA, 15 bp, Homo sapiens
cttcaaggctgcaag

SEQ ID NO: 33634 - DNA, 15 bp, Homo sapiens
acttcaaggctgcaa

SEQ ID NO: 33635 - DNA, 15 bp, Homo sapiens
tacttcaaggctgca

SEQ ID NO: 33636 - DNA, 15 bp, Homo sapiens
gtacttcaaggctgc

SEQ ID NO: 33637 - DNA, 15 bp, Homo sapiens
agtacttcaaggctg

SEQ ID NO: 33638 - DNA, 15 bp, Homo sapiens
tagtacttcaaggct

SEQ ID NO: 33639 - DNA, 15 bp, Homo sapiens
gtagtacttcaaggc

SEQ ID NO: 33640 - DNA, 15 bp, Homo sapiens
ggtagtacttcaagg

SEQ ID NO: 33641 - DNA, 15 bp, Homo sapiens
gggtagtacttcaag

SEQ ID NO: 33642 - DNA, 15 bp, Homo sapiens
tgggtagtacttcaa

SEQ ID NO: 33643 - DNA, 15 bp, Homo sapiens
gtgggtagtacttca

SEQ ID NO: 33644 - DNA, 15 bp, Homo sapiens
agtgggtagtacttc

SEQ ID NO: 33645 - DNA, 15 bp, Homo sapiens
cagtgggtagtactt

SEQ ID NO: 33646 - DNA, 15 bp, Homo sapiens
tcagtgggtagtact

SEQ ID NO: 33647 - DNA, 15 bp, Homo sapiens
ctcagtgggtagtac

SEQ ID NO: 33648 - DNA, 15 bp, Homo sapiens
cctcagtgggtagta

SEQ ID NO: 33649 - DNA, 15 bp, Homo sapiens
ccctcagtgggtagt

SEQ ID NO: 33650 - DNA, 15 bp, Homo sapiens
cccctcagtgggtag

SEQ ID NO: 33651 - DNA, 15 bp, Homo sapiens
tcccctcagtgggta

SEQ ID NO: 33652 - DNA, 15 bp, Homo sapiens
ctcccctcagtgggt

SEQ ID NO: 33653 - DNA, 15 bp, Homo sapiens
tctcccctcagtggg

SEQ ID NO: 33654 - DNA, 15 bp, Homo sapiens
ttctcccctcagtgg

SEQ ID NO: 33655 - DNA, 15 bp, Homo sapiens
cttctcccctcagtg

SEQ ID NO: 33656 - DNA, 15 bp, Homo sapiens
ccttctcccctcagt

SEQ ID NO: 33657 - DNA, 15 bp, Homo sapiens
gccttctcccctcag

SEQ ID NO: 33658 - DNA, 15 bp, Homo sapiens
tgccttctcccctca

SEQ ID NO: 33659 - DNA, 15 bp, Homo sapiens
gtgccttctcccctc

SEQ ID NO: 33660 - DNA, 15 bp, Homo sapiens
cgtgccttctcccct

SEQ ID NO: 33661 - DNA, 15 bp, Homo sapiens
ccgtgccttctcccc

SEQ ID NO: 33662 - DNA, 15 bp, Homo sapiens
gccgtgccttctccc

SEQ ID NO: 33663 - DNA, 15 bp, Homo sapiens
tgccgtgccttctcc

SEQ ID NO: 33664 - DNA, 15 bp, Homo sapiens
ttgccgtgccttctc

SEQ ID NO: 33665 - DNA, 15 bp, Homo sapiens
cttgccgtgccttct

SEQ ID NO: 33666 - DNA, 15 bp, Homo sapiens
ccttgccgtgccttc

SEQ ID NO: 33667 - DNA, 15 bp, Homo sapiens
cccttgccgtgcctt

SEQ ID NO: 33668 - DNA, 15 bp, Homo sapiens
ccccttgccgtgcct

SEQ ID NO: 33669 - DNA, 15 bp, Homo sapiens
tccccttgccgtgcc

SEQ ID NO: 33670 - DNA, 15 bp, Homo sapiens
ttccccttgccgtgc

SEQ ID NO: 33671 - DNA, 15 bp, Homo sapiens
tttccccttgccgtg

SEQ ID NO: 33672 - DNA, 15 bp, Homo sapiens
ctttccccttgccgt

SEQ ID NO: 33673 - DNA, 15 bp, Homo sapiens
cctttccccttgccg

SEQ ID NO: 33674 - DNA, 15 bp, Homo sapiens
acctttccccttgcc

SEQ ID NO: 33675 - DNA, 15 bp, Homo sapiens
aacctttccccttgc

SEQ ID NO: 33676 - DNA, 15 bp, Homo sapiens
caacctttccccttg

SEQ ID NO: 33677 - DNA, 15 bp, Homo sapiens
ccaacctttcccctt

SEQ ID NO: 33678 - DNA, 15 bp, Homo sapiens
gccaacctttcccct

SEQ ID NO: 33679 - DNA, 15 bp, Homo sapiens
tgccaacctttcccc

SEQ ID NO: 33680 - DNA, 15 bp, Homo sapiens
gtgccaacctttccc

SEQ ID NO: 33681 - DNA, 15 bp, Homo sapiens
tgtgccaacctttcc

SEQ ID NO: 33682 - DNA, 15 bp, Homo sapiens
ctgtgccaacctttc

SEQ ID NO: 33683 - DNA, 15 bp, Homo sapiens
cctgtgccaaccttt

SEQ ID NO: 33684 - DNA, 15 bp, Homo sapiens
tcctgtgccaacctt

SEQ ID NO: 33685 - DNA, 15 bp, Homo sapiens
atcctgtgccaacct

SEQ ID NO: 33686 - DNA, 15 bp, Homo sapiens
catcctgtgccaacc

SEQ ID NO: 33687 - DNA, 15 bp, Homo sapiens
ccatcctgtgccaac

SEQ ID NO: 33688 - DNA, 15 bp, Homo sapiens
tccatcctgtgccaa

SEQ ID NO: 33689 - DNA, 15 bp, Homo sapiens
ctccatcctgtgcca

SEQ ID NO: 33690 - DNA, 15 bp, Homo sapiens
gctccatcctgtgcc

SEQ ID NO: 33691 - DNA, 15 bp, Homo sapiens
tgctccatcctgtgc

SEQ ID NO: 33692 - DNA, 15 bp, Homo sapiens
ttgctccatcctgtg

SEQ ID NO: 33693 - DNA, 15 bp, Homo sapiens
cttgctccatcctgt

SEQ ID NO: 33694 - DNA, 15 bp, Homo sapiens
acttgctccatcctg

SEQ ID NO: 33695 - DNA, 15 bp, Homo sapiens
cacttgctccatcct

SEQ ID NO: 33696 - DNA, 15 bp, Homo sapiens
gcacttgctccatcc

SEQ ID NO: 33697 - DNA, 15 bp, Homo sapiens
agcacttgctccatc

SEQ ID NO: 33698 - DNA, 15 bp, Homo sapiens
aagcacttgctccat

SEQ ID NO: 33699 - DNA, 15 bp, Homo sapiens
aaagcacttgctcca

SEQ ID NO: 33700 - DNA, 15 bp, Homo sapiens
aaaagcacttgctcc

SEQ ID NO: 33701 - DNA, 15 bp, Homo sapiens
aaaaagcacttgctc

SEQ ID NO: 33702 - DNA, 15 bp, Homo sapiens
gaaaaagcacttgct

SEQ ID NO: 33703 - DNA, 15 bp, Homo sapiens
agaaaaagcacttgc

SEQ ID NO: 33704 - DNA, 15 bp, Homo sapiens
gagaaaaagcacttg

SEQ ID NO: 33705 - DNA, 15 bp, Homo sapiens
tgagaaaaagcactt

SEQ ID NO: 33706 - DNA, 15 bp, Homo sapiens
gtgagaaaaagcact

SEQ ID NO: 33707 - DNA, 15 bp, Homo sapiens
tgtgagaaaaagcac

SEQ ID NO: 33708 - DNA, 15 bp, Homo sapiens
gtgtgagaaaaagca

SEQ ID NO: 33709 - DNA, 15 bp, Homo sapiens
tgtgtgagaaaaagc

SEQ ID NO: 33710 - DNA, 15 bp, Homo sapiens
atgtgtgagaaaaag

SEQ ID NO: 33711 - DNA, 15 bp, Homo sapiens
aatgtgtgagaaaaa

SEQ ID NO: 33712 - DNA, 15 bp, Homo sapiens
gaatgtgtgagaaaa

SEQ ID NO: 33713 - DNA, 15 bp, Homo sapiens
agaatgtgtgagaaa

SEQ ID NO: 33714 - DNA, 15 bp, Homo sapiens
cagaatgtgtgagaa

SEQ ID NO: 33715 - DNA, 15 bp, Homo sapiens
ccagaatgtgtgaga

SEQ ID NO: 33716 - DNA, 15 bp, Homo sapiens
tccagaatgtgtgag

SEQ ID NO: 33717 - DNA, 15 bp, Homo sapiens
ctccagaatgtgtga

SEQ ID NO: 33718 - DNA, 15 bp, Homo sapiens
cctccagaatgtgtg

SEQ ID NO: 33719 - DNA, 15 bp, Homo sapiens
tcctccagaatgtgt

SEQ ID NO: 33720 - DNA, 15 bp, Homo sapiens
ttcctccagaatgtg

SEQ ID NO: 33721 - DNA, 15 bp, Homo sapiens
tttcctccagaatgt

SEQ ID NO: 33722 - DNA, 15 bp, Homo sapiens
ttttcctccagaatg

SEQ ID NO: 33723 - DNA, 15 bp, Homo sapiens
cttttcctccagaat

SEQ ID NO: 33724 - DNA, 15 bp, Homo sapiens
acttttcctccagaa

SEQ ID NO: 33725 - DNA, 15 bp, Homo sapiens
aacttttcctccaga

SEQ ID NO: 33726 - DNA, 15 bp, Homo sapiens
taacttttcctccag

SEQ ID NO: 33727 - DNA, 15 bp, Homo sapiens
ataacttttcctcca

SEQ ID NO: 33728 - DNA, 15 bp, Homo sapiens
gataacttttcctcc

SEQ ID NO: 33729 - DNA, 15 bp, Homo sapiens
ggataacttttcctc

SEQ ID NO: 33730 - DNA, 15 bp, Homo sapiens
tggataacttttcct

SEQ ID NO: 33731 - DNA, 15 bp, Homo sapiens
ctggataacttttcc

SEQ ID NO: 33732 - DNA, 15 bp, Homo sapiens
actggataacttttc

SEQ ID NO: 33733 - DNA, 15 bp, Homo sapiens
aactggataactttt

SEQ ID NO: 33734 - DNA, 15 bp, Homo sapiens
gaactggataacttt

SEQ ID NO: 33735 - DNA, 15 bp, Homo sapiens
agaactggataactt

SEQ ID NO: 33736 - DNA, 15 bp, Homo sapiens
aagaactggataact

SEQ ID NO: 33737 - DNA, 15 bp, Homo sapiens
gaagaactggataac

SEQ ID NO: 33738 - DNA, 15 bp, Homo sapiens
agaagaactggataa

SEQ ID NO: 33739 - DNA, 15 bp, Homo sapiens
cagaagaactggata

SEQ ID NO: 33740 - DNA, 15 bp, Homo sapiens
acagaagaactggat

SEQ ID NO: 33741 - DNA, 15 bp, Homo sapiens
aacagaagaactgga

SEQ ID NO: 33742 - DNA, 15 bp, Homo sapiens
gaacagaagaactgg

SEQ ID NO: 33743 - DNA, 15 bp, Homo sapiens
agaacagaagaactg

SEQ ID NO: 33744 - DNA, 15 bp, Homo sapiens
tagaacagaagaact

SEQ ID NO: 33745 - DNA, 15 bp, Homo sapiens
ctagaacagaagaac

SEQ ID NO: 33746 - DNA, 15 bp, Homo sapiens
tctagaacagaagaa

SEQ ID NO: 33747 - DNA, 15 bp, Homo sapiens
ttctagaacagaaga

SEQ ID NO: 33748 - DNA, 15 bp, Homo sapiens
tttctagaacagaag

SEQ ID NO: 33749 - DNA, 15 bp, Homo sapiens
gtttctagaacagaa

SEQ ID NO: 33750 - DNA, 15 bp, Homo sapiens
tgtttctagaacaga

SEQ ID NO: 33751 - DNA, 15 bp, Homo sapiens
gtgtttctagaacag

SEQ ID NO: 33752 - DNA, 15 bp, Homo sapiens
ggtgtttctagaaca

SEQ ID NO: 33753 - DNA, 15 bp, Homo sapiens
gggtgtttctagaac

SEQ ID NO: 33754 - DNA, 15 bp, Homo sapiens
ggggtgtttctagaa

SEQ ID NO: 33755 - DNA, 15 bp, Homo sapiens
aggggtgtttctaga

SEQ ID NO: 33756 - DNA, 15 bp, Homo sapiens
caggggtgtttctag

SEQ ID NO: 33757 - DNA, 15 bp, Homo sapiens
acaggggtgtttcta

SEQ ID NO: 33758 - DNA, 15 bp, Homo sapiens
gacaggggtgtttct

SEQ ID NO: 33759 - DNA, 15 bp, Homo sapiens
ggacaggggtgtttc

SEQ ID NO: 33760 - DNA, 15 bp, Homo sapiens
aggacaggggtgttt

SEQ ID NO: 33761 - DNA, 15 bp, Homo sapiens
aaggacaggggtgtt

SEQ ID NO: 33762 - DNA, 15 bp, Homo sapiens
gaaggacaggggtgt

SEQ ID NO: 33763 - DNA, 15 bp, Homo sapiens
tgaaggacaggggtg

SEQ ID NO: 33764 - DNA, 15 bp, Homo sapiens
ctgaaggacaggggt

SEQ ID NO: 33765 - DNA, 15 bp, Homo sapiens
tctgaaggacagggg

SEQ ID NO: 33766 - DNA, 15 bp, Homo sapiens
ttctgaaggacaggg

SEQ ID NO: 33767 - DNA, 15 bp, Homo sapiens
tttctgaaggacagg

SEQ ID NO: 33768 - DNA, 15 bp, Homo sapiens
gtttctgaaggacag

SEQ ID NO: 33769 - DNA, 15 bp, Homo sapiens
ggtttctgaaggaca

SEQ ID NO: 33770 - DNA, 15 bp, Homo sapiens
tggtttctgaaggac

SEQ ID NO: 33771 - DNA, 15 bp, Homo sapiens
ctggtttctgaagga

SEQ ID NO: 33772 - DNA, 15 bp, Homo sapiens
cctggtttctgaagg

SEQ ID NO: 33773 - DNA, 15 bp, Homo sapiens
ccctggtttctgaag

SEQ ID NO: 33774 - DNA, 15 bp, Homo sapiens
accctggtttctgaa

SEQ ID NO: 33775 - DNA, 15 bp, Homo sapiens
gaccctggtttctga

SEQ ID NO: 33776 - DNA, 15 bp, Homo sapiens
agaccctggtttctg

SEQ ID NO: 33777 - DNA, 15 bp, Homo sapiens
tagaccctggtttct

SEQ ID NO: 33778 - DNA, 15 bp, Homo sapiens
ctagaccctggtttc

SEQ ID NO: 33779 - DNA, 15 bp, Homo sapiens
actagaccctggttt

SEQ ID NO: 33780 - DNA, 15 bp, Homo sapiens
aactagaccctggtt

SEQ ID NO: 33781 - DNA, 15 bp, Homo sapiens
caactagaccctggt

SEQ ID NO: 33782 - DNA, 15 bp, Homo sapiens
gcaactagaccctgg

SEQ ID NO: 33783 - DNA, 15 bp, Homo sapiens
agcaactagaccctg

SEQ ID NO: 33784 - DNA, 15 bp, Homo sapiens
gagcaactagaccct

SEQ ID NO: 33785 - DNA, 15 bp, Homo sapiens
agagcaactagaccc

SEQ ID NO: 33786 - DNA, 15 bp, Homo sapiens
cagagcaactagacc

SEQ ID NO: 33787 - DNA, 15 bp, Homo sapiens
ccagagcaactagac

SEQ ID NO: 33788 - DNA, 15 bp, Homo sapiens
gccagagcaactaga

SEQ ID NO: 33789 - DNA, 15 bp, Homo sapiens
agccagagcaactag

SEQ ID NO: 33790 - DNA, 15 bp, Homo sapiens
tagccagagcaacta

SEQ ID NO: 33791 - DNA, 15 bp, Homo sapiens
gtagccagagcaact

SEQ ID NO: 33792 - DNA, 15 bp, Homo sapiens
ggtagccagagcaac

SEQ ID NO: 33793 - DNA, 15 bp, Homo sapiens
tggtagccagagcaa

SEQ ID NO: 33794 - DNA, 15 bp, Homo sapiens
ctggtagccagagca

SEQ ID NO: 33795 - DNA, 15 bp, Homo sapiens
cctggtagccagagc

SEQ ID NO: 33796 - DNA, 15 bp, Homo sapiens
gcctggtagccagag

SEQ ID NO: 33797 - DNA, 15 bp, Homo sapiens
cgcctggtagccaga

SEQ ID NO: 33798 - DNA, 15 bp, Homo sapiens
acgcctggtagccag

SEQ ID NO: 33799 - DNA, 15 bp, Homo sapiens
cacgcctggtagcca

SEQ ID NO: 33800 - DNA, 15 bp, Homo sapiens
tcacgcctggtagcc

SEQ ID NO: 33801 - DNA, 15 bp, Homo sapiens
ctcacgcctggtagc

SEQ ID NO: 33802 - DNA, 15 bp, Homo sapiens
gctcacgcctggtag

SEQ ID NO: 33803 - DNA, 15 bp, Homo sapiens
tgctcacgcctggta

SEQ ID NO: 33804 - DNA, 15 bp, Homo sapiens
ctgctcacgcctggt

SEQ ID NO: 33805 - DNA, 15 bp, Homo sapiens
cctgctcacgcctgg

SEQ ID NO: 33806 - DNA, 15 bp, Homo sapiens
acctgctcacgcctg

SEQ ID NO: 33807 - DNA, 15 bp, Homo sapiens
cacctgctcacgcct

SEQ ID NO: 33808 - DNA, 15 bp, Homo sapiens
ccacctgctcacgcc

SEQ ID NO: 33809 - DNA, 15 bp, Homo sapiens
accacctgctcacgc

SEQ ID NO: 33810 - DNA, 15 bp, Homo sapiens
caccacctgctcacg

SEQ ID NO: 33811 - DNA, 15 bp, Homo sapiens
ccaccacctgctcac

SEQ ID NO: 33812 - DNA, 15 bp, Homo sapiens
accaccacctgctca

SEQ ID NO: 33813 - DNA, 15 bp, Homo sapiens
taccaccacctgctc

SEQ ID NO: 33814 - DNA, 15 bp, Homo sapiens
ctaccaccacctgct

SEQ ID NO: 33815 - DNA, 15 bp, Homo sapiens
gctaccaccacctgc

SEQ ID NO: 33816 - DNA, 15 bp, Homo sapiens
tgctaccaccacctg

SEQ ID NO: 33817 - DNA, 15 bp, Homo sapiens
gtgctaccaccacct

SEQ ID NO: 33818 - DNA, 15 bp, Homo sapiens
ggtgctaccaccacc

SEQ ID NO: 33819 - DNA, 15 bp, Homo sapiens
tggtgctaccaccac

SEQ ID NO: 33820 - DNA, 15 bp, Homo sapiens
gtggtgctaccacca

SEQ ID NO: 33821 - DNA, 15 bp, Homo sapiens
tgtggtgctaccacc

SEQ ID NO: 33822 - DNA, 15 bp, Homo sapiens
ctgtggtgctaccac

SEQ ID NO: 33823 - DNA, 15 bp, Homo sapiens
cctgtggtgctacca

SEQ ID NO: 33824 - DNA, 15 bp, Homo sapiens
gcctgtggtgctacc

SEQ ID NO: 33825 - DNA, 15 bp, Homo sapiens
ggcctgtggtgctac

SEQ ID NO: 33826 - DNA, 15 bp, Homo sapiens
gggcctgtggtgcta

SEQ ID NO: 33827 - DNA, 15 bp, Homo sapiens
ggggcctgtggtgct

SEQ ID NO: 33828 - DNA, 15 bp, Homo sapiens
cggggcctgtggtgc

SEQ ID NO: 33829 - DNA, 15 bp, Homo sapiens
ccggggcctgtggtg

SEQ ID NO: 33830 - DNA, 15 bp, Homo sapiens
accggggcctgtggt

SEQ ID NO: 33831 - DNA, 15 bp, Homo sapiens
aaccggggcctgtgg

SEQ ID NO: 33832 - DNA, 15 bp, Homo sapiens
taaccggggcctgtg

SEQ ID NO: 33833 - DNA, 15 bp, Homo sapiens
gtaaccggggcctgt

SEQ ID NO: 33834 - DNA, 15 bp, Homo sapiens
ggtaaccggggcctg

SEQ ID NO: 33835 - DNA, 15 bp, Homo sapiens
tggtaaccggggcct

SEQ ID NO: 33836 - DNA, 15 bp, Homo sapiens
atggtaaccggggcc

SEQ ID NO: 33837 - DNA, 15 bp, Homo sapiens
gatggtaaccggggc

SEQ ID NO: 33838 - DNA, 15 bp, Homo sapiens
tgatggtaaccgggg

SEQ ID NO: 33839 - DNA, 15 bp, Homo sapiens
gtgatggtaaccggg

SEQ ID NO: 33840 - DNA, 15 bp, Homo sapiens
agtgatggtaaccgg

SEQ ID NO: 33841 - DNA, 15 bp, Homo sapiens
cagtgatggtaaccg

SEQ ID NO: 33842 - DNA, 15 bp, Homo sapiens
acagtgatggtaacc

SEQ ID NO: 33843 - DNA, 15 bp, Homo sapiens
gacagtgatggtaac

SEQ ID NO: 33844 - DNA, 15 bp, Homo sapiens
ggacagtgatggtaa

SEQ ID NO: 33845 - DNA, 15 bp, Homo sapiens
gggacagtgatggta

SEQ ID NO: 33846 - DNA, 15 bp, Homo sapiens
tgggacagtgatggt

SEQ ID NO: 33847 - DNA, 15 bp, Homo sapiens
atgggacagtgatgg

SEQ ID NO: 33848 - DNA, 15 bp, Homo sapiens
catgggacagtgatg

SEQ ID NO: 33849 - DNA, 15 bp, Homo sapiens
acatgggacagtgat

SEQ ID NO: 33850 - DNA, 15 bp, Homo sapiens
gacatgggacagtga

SEQ ID NO: 33851 - DNA, 15 bp, Homo sapiens
agacatgggacagtg

SEQ ID NO: 33852 - DNA, 15 bp, Homo sapiens
aagacatgggacagt

SEQ ID NO: 33853 - DNA, 15 bp, Homo sapiens
aaagacatgggacag

SEQ ID NO: 33854 - DNA, 15 bp, Homo sapiens
caaagacatgggaca

SEQ ID NO: 33855 - DNA, 15 bp, Homo sapiens
tcaaagacatgggac

SEQ ID NO: 33856 - DNA, 15 bp, Homo sapiens
atcaaagacatggga

SEQ ID NO: 33857 - DNA, 15 bp, Homo sapiens
gatcaaagacatggg

SEQ ID NO: 33858 - DNA, 15 bp, Homo sapiens
agatcaaagacatgg

SEQ ID NO: 33859 - DNA, 15 bp, Homo sapiens
aagatcaaagacatg

SEQ ID NO: 33860 - DNA, 15 bp, Homo sapiens
gaagatcaaagacat

SEQ ID NO: 33861 - DNA, 15 bp, Homo sapiens
cgaagatcaaagaca

SEQ ID NO: 33862 - DNA, 15 bp, Homo sapiens
acgaagatcaaagac

SEQ ID NO: 33863 - DNA, 15 bp, Homo sapiens
gacgaagatcaaaga

SEQ ID NO: 33864 - DNA, 15 bp, Homo sapiens
ggacgaagatcaaag

SEQ ID NO: 33865 - DNA, 15 bp, Homo sapiens
aggacgaagatcaaa

SEQ ID NO: 33866 - DNA, 15 bp, Homo sapiens
aaggacgaagatcaa

SEQ ID NO: 33867 - DNA, 15 bp, Homo sapiens
caaggacgaagatca

SEQ ID NO: 33868 - DNA, 15 bp, Homo sapiens
acaaggacgaagatc

SEQ ID NO: 33869 - DNA, 15 bp, Homo sapiens
cacaaggacgaagat

SEQ ID NO: 33870 - DNA, 15 bp, Homo sapiens
ccacaaggacgaaga

SEQ ID NO: 33871 - DNA, 15 bp, Homo sapiens
cccacaaggacgaag

SEQ ID NO: 33872 - DNA, 15 bp, Homo sapiens
ccccacaaggacgaa

SEQ ID NO: 33873 - DNA, 15 bp, Homo sapiens
tccccacaaggacga

SEQ ID NO: 33874 - DNA, 15 bp, Homo sapiens
gtccccacaaggacg

SEQ ID NO: 33875 - DNA, 15 bp, Homo sapiens
agtccccacaaggac

SEQ ID NO: 33876 - DNA, 15 bp, Homo sapiens
cagtccccacaagga

SEQ ID NO: 33877 - DNA, 15 bp, Homo sapiens
ccagtccccacaagg

SEQ ID NO: 33878 - DNA, 15 bp, Homo sapiens
gccagtccccacaag

SEQ ID NO: 33879 - DNA, 15 bp, Homo sapiens
ggccagtccccacaa

SEQ ID NO: 33880 - DNA, 15 bp, Homo sapiens
aggccagtccccaca

SEQ ID NO: 33881 - DNA, 15 bp, Homo sapiens
caggccagtccccac

SEQ ID NO: 33882 - DNA, 15 bp, Homo sapiens
gcaggccagtcccca

SEQ ID NO: 33883 - DNA, 15 bp, Homo sapiens
tgcaggccagtcccc

SEQ ID NO: 33884 - DNA, 15 bp, Homo sapiens
atgcaggccagtccc

SEQ ID NO: 33885 - DNA, 15 bp, Homo sapiens
catgcaggccagtcc

SEQ ID NO: 33886 - DNA, 15 bp, Homo sapiens
ccatgcaggccagtc

SEQ ID NO: 33887 - DNA, 15 bp, Homo sapiens
gccatgcaggccagt

SEQ ID NO: 33888 - DNA, 15 bp, Homo sapiens
ggccatgcaggccag

SEQ ID NO: 33889 - DNA, 15 bp, Homo sapiens
aggccatgcaggcca

SEQ ID NO: 33890 - DNA, 15 bp, Homo sapiens
gaggccatgcaggcc

SEQ ID NO: 33891 - DNA, 15 bp, Homo sapiens
cgaggccatgcaggc

SEQ ID NO: 33892 - DNA, 15 bp, Homo sapiens
ccgaggccatgcagg

SEQ ID NO: 33893 - DNA, 15 bp, Homo sapiens
accgaggccatgcag

SEQ ID NO: 33894 - DNA, 15 bp, Homo sapiens
caccgaggccatgca

SEQ ID NO: 33895 - DNA, 15 bp, Homo sapiens
ccaccgaggccatgc

SEQ ID NO: 33896 - DNA, 15 bp, Homo sapiens
gccaccgaggccatg

SEQ ID NO: 33897 - DNA, 15 bp, Homo sapiens
tgccaccgaggccat

SEQ ID NO: 33898 - DNA, 15 bp, Homo sapiens
ctgccaccgaggcca

SEQ ID NO: 33899 - DNA, 15 bp, Homo sapiens
gctgccaccgaggcc

SEQ ID NO: 33900 - DNA, 15 bp, Homo sapiens
cgctgccaccgaggc

SEQ ID NO: 33901 - DNA, 15 bp, Homo sapiens
tcgctgccaccgagg

SEQ ID NO: 33902 - DNA, 15 bp, Homo sapiens
ctcgctgccaccgag

SEQ ID NO: 33903 - DNA, 15 bp, Homo sapiens
gctcgctgccaccga

SEQ ID NO: 33904 - DNA, 15 bp, Homo sapiens
ggctcgctgccaccg

SEQ ID NO: 33905 - DNA, 15 bp, Homo sapiens
gggctcgctgccacc

SEQ ID NO: 33906 - DNA, 15 bp, Homo sapiens
agggctcgctgccac

SEQ ID NO: 33907 - DNA, 15 bp, Homo sapiens
cagggctcgctgcca

SEQ ID NO: 33908 - DNA, 15 bp, Homo sapiens
gcagggctcgctgcc

SEQ ID NO: 33909 - DNA, 15 bp, Homo sapiens
tgcagggctcgctgc

SEQ ID NO: 33910 - DNA, 15 bp, Homo sapiens
ctgcagggctcgctg

SEQ ID NO: 33911 - DNA, 15 bp, Homo sapiens
tctgcagggctcgct

SEQ ID NO: 33912 - DNA, 15 bp, Homo sapiens
ctctgcagggctcgc

SEQ ID NO: 33913 - DNA, 15 bp, Homo sapiens
cctctgcagggctcg

SEQ ID NO: 33914 - DNA, 15 bp, Homo sapiens
gcctctgcagggctc

SEQ ID NO: 33915 - DNA, 15 bp, Homo sapiens
tgcctctgcagggct

SEQ ID NO: 33916 - DNA, 15 bp, Homo sapiens
ttgcctctgcagggc

SEQ ID NO: 33917 - DNA, 15 bp, Homo sapiens
cttgcctctgcaggg

SEQ ID NO: 33918 - DNA, 15 bp, Homo sapiens
acttgcctctgcagg

SEQ ID NO: 33919 - DNA, 15 bp, Homo sapiens
cacttgcctctgcag

SEQ ID NO: 33920 - DNA, 15 bp, Homo sapiens
gcacttgcctctgca

SEQ ID NO: 33921 - DNA, 15 bp, Homo sapiens
tgcacttgcctctgc

SEQ ID NO: 33922 - DNA, 15 bp, Homo sapiens
atgcacttgcctctg

SEQ ID NO: 33923 - DNA, 15 bp, Homo sapiens
gatgcacttgcctct

SEQ ID NO: 33924 - DNA, 15 bp, Homo sapiens
tgatgcacttgcctc

SEQ ID NO: 33925 - DNA, 15 bp, Homo sapiens
ctgatgcacttgcct

SEQ ID NO: 33926 - DNA, 15 bp, Homo sapiens
gctgatgcacttgcc

SEQ ID NO: 33927 - DNA, 15 bp, Homo sapiens
tgctgatgcacttgc

SEQ ID NO: 33928 - DNA, 15 bp, Homo sapiens
atgctgatgcacttg

SEQ ID NO: 33929 - DNA, 15 bp, Homo sapiens
gatgctgatgcactt

SEQ ID NO: 33930 - DNA, 15 bp, Homo sapiens
tgatgctgatgcact

SEQ ID NO: 33931 - DNA, 15 bp, Homo sapiens
gtgatgctgatgcac

SEQ ID NO: 33932 - DNA, 15 bp, Homo sapiens
agtgatgctgatgca

SEQ ID NO: 33933 - DNA, 15 bp, Homo sapiens
cagtgatgctgatgc

SEQ ID NO: 33934 - DNA, 15 bp, Homo sapiens
acagtgatgctgatg

SEQ ID NO: 33935 - DNA, 15 bp, Homo sapiens
cacagtgatgctgat

SEQ ID NO: 33936 - DNA, 15 bp, Homo sapiens
acacagtgatgctga

SEQ ID NO: 33937 - DNA, 15 bp, Homo sapiens
aacacagtgatgctg

SEQ ID NO: 33938 - DNA, 15 bp, Homo sapiens
aaacacagtgatgct

SEQ ID NO: 33939 - DNA, 15 bp, Homo sapiens
caaacacagtgatgc

SEQ ID NO: 33940 - DNA, 15 bp, Homo sapiens
acaaacacagtgatg

SEQ ID NO: 33941 - DNA, 15 bp, Homo sapiens
aacaaacacagtgat

SEQ ID NO: 33942 - DNA, 15 bp, Homo sapiens
gaacaaacacagtga

SEQ ID NO: 33943 - DNA, 15 bp, Homo sapiens
ggaacaaacacagtg

SEQ ID NO: 33944 - DNA, 15 bp, Homo sapiens
gggaacaaacacagt

SEQ ID NO: 33945 - DNA, 15 bp, Homo sapiens
tgggaacaaacacag

SEQ ID NO: 33946 - DNA, 15 bp, Homo sapiens
ctgggaacaaacaca

SEQ ID NO: 33947 - DNA, 15 bp, Homo sapiens
cctgggaacaaacac

SEQ ID NO: 33948 - DNA, 15 bp, Homo sapiens
acctgggaacaaaca

SEQ ID NO: 33949 - DNA, 15 bp, Homo sapiens
aacctgggaacaaac

SEQ ID NO: 33950 - DNA, 15 bp, Homo sapiens
taacctgggaacaaa

SEQ ID NO: 33951 - DNA, 15 bp, Homo sapiens
gtaacctgggaacaa

SEQ ID NO: 33952 - DNA, 15 bp, Homo sapiens
cgtaacctgggaaca

SEQ ID NO: 33953 - DNA, 15 bp, Homo sapiens
acgtaacctgggaac

SEQ ID NO: 33954 - DNA, 15 bp, Homo sapiens
gacgtaacctgggaa

SEQ ID NO: 33955 - DNA, 15 bp, Homo sapiens
cgacgtaacctggga

SEQ ID NO: 33956 - DNA, 15 bp, Homo sapiens
ccgacgtaacctggg

SEQ ID NO: 33957 - DNA, 15 bp, Homo sapiens
gccgacgtaacctgg

SEQ ID NO: 33958 - DNA, 15 bp, Homo sapiens
cgccgacgtaacctg

SEQ ID NO: 33959 - DNA, 15 bp, Homo sapiens
gcgccgacgtaacct

SEQ ID NO: 33960 - DNA, 15 bp, Homo sapiens
agcgccgacgtaacc

SEQ ID NO: 33961 - DNA, 15 bp, Homo sapiens
cagcgccgacgtaac

SEQ ID NO: 33962 - DNA, 15 bp, Homo sapiens
gcagcgccgacgtaa

SEQ ID NO: 33963 - DNA, 15 bp, Homo sapiens
agcagcgccgacgta

SEQ ID NO: 33964 - DNA, 15 bp, Homo sapiens
tagcagcgccgacgt

SEQ ID NO: 33965 - DNA, 15 bp, Homo sapiens
gtagcagcgccgacg

SEQ ID NO: 33966 - DNA, 15 bp, Homo sapiens
ggtagcagcgccgac

SEQ ID NO: 33967 - DNA, 15 bp, Homo sapiens
cggtagcagcgccga

SEQ ID NO: 33968 - DNA, 15 bp, Homo sapiens
acggtagcagcgccg

SEQ ID NO: 33969 - DNA, 15 bp, Homo sapiens
cacggtagcagcgcc

SEQ ID NO: 33970 - DNA, 15 bp, Homo sapiens
ccacggtagcagcgc

SEQ ID NO: 33971 - DNA, 15 bp, Homo sapiens
cccacggtagcagcg

SEQ ID NO: 33972 - DNA, 15 bp, Homo sapiens
acccacggtagcagc

SEQ ID NO: 33973 - DNA, 15 bp, Homo sapiens
cacccacggtagcag

SEQ ID NO: 33974 - DNA, 15 bp, Homo sapiens
gcacccacggtagca

SEQ ID NO: 33975 - DNA, 15 bp, Homo sapiens
agcacccacggtagc

SEQ ID NO: 33976 - DNA, 15 bp, Homo sapiens
cagcacccacggtag

SEQ ID NO: 33977 - DNA, 15 bp, Homo sapiens
gcagcacccacggta

SEQ ID NO: 33978 - DNA, 15 bp, Homo sapiens
agcagcacccacggt

SEQ ID NO: 33979 - DNA, 15 bp, Homo sapiens
cagcagcacccacgg

SEQ ID NO: 33980 - DNA, 15 bp, Homo sapiens
gcagcagcacccacg

SEQ ID NO: 33981 - DNA, 15 bp, Homo sapiens
tgcagcagcacccac

SEQ ID NO: 33982 - DNA, 15 bp, Homo sapiens
atgcagcagcaccca

SEQ ID NO: 33983 - DNA, 15 bp, Homo sapiens
catgcagcagcaccc

SEQ ID NO: 33984 - DNA, 15 bp, Homo sapiens
ccatgcagcagcacc

SEQ ID NO: 33985 - DNA, 15 bp, Homo sapiens
accatgcagcagcac

SEQ ID NO: 33986 - DNA, 15 bp, Homo sapiens
caccatgcagcagca

SEQ ID NO: 33987 - DNA, 15 bp, Homo sapiens
ccaccatgcagcagc

SEQ ID NO: 33988 - DNA, 15 bp, Homo sapiens
accaccatgcagcag

SEQ ID NO: 33989 - DNA, 15 bp, Homo sapiens
aaccaccatgcagca

SEQ ID NO: 33990 - DNA, 15 bp, Homo sapiens
gaaccaccatgcagc

SEQ ID NO: 33991 - DNA, 15 bp, Homo sapiens
tgaaccaccatgcag

SEQ ID NO: 33992 - DNA, 15 bp, Homo sapiens
atgaaccaccatgca

SEQ ID NO: 33993 - DNA, 15 bp, Homo sapiens
aatgaaccaccatgc

SEQ ID NO: 33994 - DNA, 15 bp, Homo sapiens
caatgaaccaccatg

SEQ ID NO: 33995 - DNA, 15 bp, Homo sapiens
gcaatgaaccaccat

SEQ ID NO: 33996 - DNA, 15 bp, Homo sapiens
agcaatgaaccacca

SEQ ID NO: 33997 - DNA, 15 bp, Homo sapiens
cagcaatgaaccacc

SEQ ID NO: 33998 - DNA, 15 bp, Homo sapiens
gcagcaatgaaccac

SEQ ID NO: 33999 - DNA, 15 bp, Homo sapiens
agcagcaatgaacca

SEQ ID NO: 34000 - DNA, 15 bp, Homo sapiens
cagcagcaatgaacc

SEQ ID NO: 34001 - DNA, 15 bp, Homo sapiens
tcagcagcaatgaac

SEQ ID NO: 34002 - DNA, 15 bp, Homo sapiens
gtcagcagcaatgaa

SEQ ID NO: 34003 - DNA, 15 bp, Homo sapiens
cgtcagcagcaatga

SEQ ID NO: 34004 - DNA, 15 bp, Homo sapiens
ccgtcagcagcaatg

SEQ ID NO: 34005 - DNA, 15 bp, Homo sapiens
accgtcagcagcaat

SEQ ID NO: 34006 - DNA, 15 bp, Homo sapiens
caccgtcagcagcaa

SEQ ID NO: 34007 - DNA, 15 bp, Homo sapiens
ccaccgtcagcagca

SEQ ID NO: 34008 - DNA, 15 bp, Homo sapiens
accaccgtcagcagc

SEQ ID NO: 34009 - DNA, 15 bp, Homo sapiens
gaccaccgtcagcag

SEQ ID NO: 34010 - DNA, 15 bp, Homo sapiens
ggaccaccgtcagca

SEQ ID NO: 34011 - DNA, 15 bp, Homo sapiens
tggaccaccgtcagc

SEQ ID NO: 34012 - DNA, 15 bp, Homo sapiens
ttggaccaccgtcag

SEQ ID NO: 34013 - DNA, 15 bp, Homo sapiens
cttggaccaccgtca

SEQ ID NO: 34014 - DNA, 15 bp, Homo sapiens
tcttggaccaccgtc

SEQ ID NO: 34015 - DNA, 15 bp, Homo sapiens
ctcttggaccaccgt

SEQ ID NO: 34016 - DNA, 15 bp, Homo sapiens
actcttggaccaccg

SEQ ID NO: 34017 - DNA, 15 bp, Homo sapiens
cactcttggaccacc

SEQ ID NO: 34018 - DNA, 15 bp, Homo sapiens
acactcttggaccac

SEQ ID NO: 34019 - DNA, 15 bp, Homo sapiens
gacactcttggacca

SEQ ID NO: 34020 - DNA, 15 bp, Homo sapiens
ggacactcttggacc

SEQ ID NO: 34021 - DNA, 15 bp, Homo sapiens
aggacactcttggac

SEQ ID NO: 34022 - DNA, 15 bp, Homo sapiens
aaggacactcttgga

SEQ ID NO: 34023 - DNA, 15 bp, Homo sapiens
gaaggacactcttgg

SEQ ID NO: 34024 - DNA, 15 bp, Homo sapiens
agaaggacactcttg

SEQ ID NO: 34025 - DNA, 15 bp, Homo sapiens
tagaaggacactctt

SEQ ID NO: 34026 - DNA, 15 bp, Homo sapiens
gtagaaggacactct

SEQ ID NO: 34027 - DNA, 15 bp, Homo sapiens
ggtagaaggacactc

SEQ ID NO: 34028 - DNA, 15 bp, Homo sapiens
tggtagaaggacact

SEQ ID NO: 34029 - DNA, 15 bp, Homo sapiens
ctggtagaaggacac

SEQ ID NO: 34030 - DNA, 15 bp, Homo sapiens
gctggtagaaggaca

SEQ ID NO: 34031 - DNA, 15 bp, Homo sapiens
agctggtagaaggac

SEQ ID NO: 34032 - DNA, 15 bp, Homo sapiens
cagctggtagaagga

SEQ ID NO: 34033 - DNA, 15 bp, Homo sapiens
ccagctggtagaagg

SEQ ID NO: 34034 - DNA, 15 bp, Homo sapiens
accagctggtagaag

SEQ ID NO: 34035 - DNA, 15 bp, Homo sapiens
taccagctggtagaa

SEQ ID NO: 34036 - DNA, 15 bp, Homo sapiens
gtaccagctggtaga

SEQ ID NO: 34037 - DNA, 15 bp, Homo sapiens
agtaccagctggtag

SEQ ID NO: 34038 - DNA, 15 bp, Homo sapiens
gagtaccagctggta

SEQ ID NO: 34039 - DNA, 15 bp, Homo sapiens
tgagtaccagctggt

SEQ ID NO: 34040 - DNA, 15 bp, Homo sapiens
ctgagtaccagctgg

SEQ ID NO: 34041 - DNA, 15 bp, Homo sapiens
actgagtaccagctg

SEQ ID NO: 34042 - DNA, 15 bp, Homo sapiens
gactgagtaccagct

SEQ ID NO: 34043 - DNA, 15 bp, Homo sapiens
tgactgagtaccagc

SEQ ID NO: 34044 - DNA, 15 bp, Homo sapiens
gtgactgagtaccag

SEQ ID NO: 34045 - DNA, 15 bp, Homo sapiens
ggtgactgagtacca

SEQ ID NO: 34046 - DNA, 15 bp, Homo sapiens
aggtgactgagtacc

SEQ ID NO: 34047 - DNA, 15 bp, Homo sapiens
aaggtgactgagtac

SEQ ID NO: 34048 - DNA, 15 bp, Homo sapiens
aaaggtgactgagta

SEQ ID NO: 34049 - DNA, 15 bp, Homo sapiens
gaaaggtgactgagt

SEQ ID NO: 34050 - DNA, 15 bp, Homo sapiens
agaaaggtgactgag

SEQ ID NO: 34051 - DNA, 15 bp, Homo sapiens
aagaaaggtgactga

SEQ ID NO: 34052 - DNA, 15 bp, Homo sapiens
aaagaaaggtgactg

SEQ ID NO: 34053 - DNA, 15 bp, Homo sapiens
gaaagaaaggtgact

SEQ ID NO: 34054 - DNA, 15 bp, Homo sapiens
agaaagaaaggtgac

SEQ ID NO: 34055 - DNA, 15 bp, Homo sapiens
cagaaagaaaggtga

SEQ ID NO: 34056 - DNA, 15 bp, Homo sapiens
acagaaagaaaggtg

SEQ ID NO: 34057 - DNA, 15 bp, Homo sapiens
tacagaaagaaaggt

SEQ ID NO: 34058 - DNA, 15 bp, Homo sapiens
gtacagaaagaaagg

SEQ ID NO: 34059 - DNA, 15 bp, Homo sapiens
ggtacagaaagaaag

SEQ ID NO: 34060 - DNA, 15 bp, Homo sapiens
aggtacagaaagaaa

SEQ ID NO: 34061 - DNA, 15 bp, Homo sapiens
aaggtacagaaagaa

SEQ ID NO: 34062 - DNA, 15 bp, Homo sapiens
taaggtacagaaaga

SEQ ID NO: 34063 - DNA, 15 bp, Homo sapiens
gtaaggtacagaaag

SEQ ID NO: 34064 - DNA, 15 bp, Homo sapiens
tgtaaggtacagaaa

SEQ ID NO: 34065 - DNA, 15 bp, Homo sapiens
atgtaaggtacagaa

SEQ ID NO: 34066 - DNA, 15 bp, Homo sapiens
catgtaaggtacaga

SEQ ID NO: 34067 - DNA, 15 bp, Homo sapiens
tcatgtaaggtacag

SEQ ID NO: 34068 - DNA, 15 bp, Homo sapiens
ctcatgtaaggtaca

SEQ ID NO: 34069 - DNA, 15 bp, Homo sapiens
tctcatgtaaggtac

SEQ ID NO: 34070 - DNA, 15 bp, Homo sapiens
ttctcatgtaaggta

SEQ ID NO: 34071 - DNA, 15 bp, Homo sapiens
cttctcatgtaaggt

SEQ ID NO: 34072 - DNA, 15 bp, Homo sapiens
acttctcatgtaagg

SEQ ID NO: 34073 - DNA, 15 bp, Homo sapiens
cacttctcatgtaag

SEQ ID NO: 34074 - DNA, 15 bp, Homo sapiens
acacttctcatgtaa

SEQ ID NO: 34075 - DNA, 15 bp, Homo sapiens
aacacttctcatgta

SEQ ID NO: 34076 - DNA, 15 bp, Homo sapiens
caacacttctcatgt

SEQ ID NO: 34077 - DNA, 15 bp, Homo sapiens
acaacacttctcatg

SEQ ID NO: 34078 - DNA, 15 bp, Homo sapiens
cacaacacttctcat

SEQ ID NO: 34079 - DNA, 15 bp, Homo sapiens
tcacaacacttctca

SEQ ID NO: 34080 - DNA, 15 bp, Homo sapiens
ctcacaacacttctc

SEQ ID NO: 34081 - DNA, 15 bp, Homo sapiens
cctcacaacacttct

SEQ ID NO: 34082 - DNA, 15 bp, Homo sapiens
gcctcacaacacttc

SEQ ID NO: 34083 - DNA, 15 bp, Homo sapiens
ggcctcacaacactt

SEQ ID NO: 34084 - DNA, 15 bp, Homo sapiens
aggcctcacaacact

SEQ ID NO: 34085 - DNA, 15 bp, Homo sapiens
aaggcctcacaacac

SEQ ID NO: 34086 - DNA, 15 bp, Homo sapiens
caaggcctcacaaca

SEQ ID NO: 34087 - DNA, 15 bp, Homo sapiens
tcaaggcctcacaac

SEQ ID NO: 34088 - DNA, 15 bp, Homo sapiens
gtcaaggcctcacaa

SEQ ID NO: 34089 - DNA, 15 bp, Homo sapiens
ggtcaaggcctcaca

SEQ ID NO: 34090 - DNA, 15 bp, Homo sapiens
aggtcaaggcctcac

SEQ ID NO: 34091 - DNA, 15 bp, Homo sapiens
aaggtcaaggcctca

SEQ ID NO: 34092 - DNA, 15 bp, Homo sapiens
aaaggtcaaggcctc

SEQ ID NO: 34093 - DNA, 15 bp, Homo sapiens
gaaaggtcaaggcct

SEQ ID NO: 34094 - DNA, 15 bp, Homo sapiens
agaaaggtcaaggcc

SEQ ID NO: 34095 - DNA, 15 bp, Homo sapiens
cagaaaggtcaaggc

SEQ ID NO: 34096 - DNA, 15 bp, Homo sapiens
acagaaaggtcaagg

SEQ ID NO: 34097 - DNA, 15 bp, Homo sapiens
cacagaaaggtcaag

SEQ ID NO: 34098 - DNA, 15 bp, Homo sapiens
ccacagaaaggtcaa

SEQ ID NO: 34099 - DNA, 15 bp, Homo sapiens
accacagaaaggtca

SEQ ID NO: 34100 - DNA, 15 bp, Homo sapiens
aaccacagaaaggtc

SEQ ID NO: 34101 - DNA, 15 bp, Homo sapiens
aaaccacagaaaggt

SEQ ID NO: 34102 - DNA, 15 bp, Homo sapiens
gaaaccacagaaagg

SEQ ID NO: 34103 - DNA, 15 bp, Homo sapiens
cgaaaccacagaaag

SEQ ID NO: 34104 - DNA, 15 bp, Homo sapiens
ccgaaaccacagaaa

SEQ ID NO: 34105 - DNA, 15 bp, Homo sapiens
accgaaaccacagaa

SEQ ID NO: 34106 - DNA, 15 bp, Homo sapiens
taccgaaaccacaga

SEQ ID NO: 34107 - DNA, 15 bp, Homo sapiens
ataccgaaaccacag

SEQ ID NO: 34108 - DNA, 15 bp, Homo sapiens
gataccgaaaccaca

SEQ ID NO: 34109 - DNA, 15 bp, Homo sapiens
agataccgaaaccac

SEQ ID NO: 34110 - DNA, 15 bp, Homo sapiens
tagataccgaaacca

SEQ ID NO: 34111 - DNA, 15 bp, Homo sapiens
atagataccgaaacc

SEQ ID NO: 34112 - DNA, 15 bp, Homo sapiens
gatagataccgaaac

SEQ ID NO: 34113 - DNA, 15 bp, Homo sapiens
tgatagataccgaaa

SEQ ID NO: 34114 - DNA, 15 bp, Homo sapiens
ttgatagataccgaa

SEQ ID NO: 34115 - DNA, 15 bp, Homo sapiens
tttgatagataccga

SEQ ID NO: 34116 - DNA, 15 bp, Homo sapiens
atttgatagataccg

SEQ ID NO: 34117 - DNA, 15 bp, Homo sapiens
gatttgatagatacc

SEQ ID NO: 34118 - DNA, 15 bp, Homo sapiens
tgatttgatagatac

SEQ ID NO: 34119 - DNA, 15 bp, Homo sapiens
atgatttgatagata

SEQ ID NO: 34120 - DNA, 15 bp, Homo sapiens
gatgatttgatagat

SEQ ID NO: 34121 - DNA, 15 bp, Homo sapiens
agatgatttgataga

SEQ ID NO: 34122 - DNA, 15 bp, Homo sapiens
aagatgatttgatag

SEQ ID NO: 34123 - DNA, 15 bp, Homo sapiens
taagatgatttgata

SEQ ID NO: 34124 - DNA, 15 bp, Homo sapiens
ttaagatgatttgat

SEQ ID NO: 34125 - DNA, 15 bp, Homo sapiens
cttaagatgatttga

SEQ ID NO: 34126 - DNA, 15 bp, Homo sapiens
tcttaagatgatttg

SEQ ID NO: 34127 - DNA, 15 bp, Homo sapiens
gtcttaagatgattt

SEQ ID NO: 34128 - DNA, 15 bp, Homo sapiens
agtcttaagatgatt

SEQ ID NO: 34129 - DNA, 15 bp, Homo sapiens
gagtcttaagatgat

SEQ ID NO: 34130 - DNA, 15 bp, Homo sapiens
tgagtcttaagatga

SEQ ID NO: 34131 - DNA, 15 bp, Homo sapiens
ctgagtcttaagatg

SEQ ID NO: 34132 - DNA, 15 bp, Homo sapiens
tctgagtcttaagat

SEQ ID NO: 34133 - DNA, 15 bp, Homo sapiens
gtctgagtcttaaga

SEQ ID NO: 34134 - DNA, 15 bp, Homo sapiens
tgtctgagtcttaag

SEQ ID NO: 34135 - DNA, 15 bp, Homo sapiens
ttgtctgagtcttaa

SEQ ID NO: 34136 - DNA, 15 bp, Homo sapiens
attgtctgagtctta

SEQ ID NO: 34137 - DNA, 15 bp, Homo sapiens
tattgtctgagtctt

SEQ ID NO: 34138 - DNA, 15 bp, Homo sapiens
ttattgtctgagtct

SEQ ID NO: 34139 - DNA, 15 bp, Homo sapiens
tttattgtctgagtc

SEQ ID NO: 34140 - DNA, 15 bp, Homo sapiens
gtttattgtctgagt

SEQ ID NO: 34141 - DNA, 15 bp, Homo sapiens
tgtttattgtctgag

SEQ ID NO: 34142 - DNA, 15 bp, Homo sapiens
ctgtttattgtctga

SEQ ID NO: 34143 - DNA, 15 bp, Homo sapiens
actgtttattgtctg

SEQ ID NO: 34144 - DNA, 15 bp, Homo sapiens
aactgtttattgtct

SEQ ID NO: 34145 - DNA, 15 bp, Homo sapiens
taactgtttattgtc

SEQ ID NO: 34146 - DNA, 15 bp, Homo sapiens
gtaactgtttattgt

SEQ ID NO: 34147 - DNA, 15 bp, Homo sapiens
tgtaactgtttattg

SEQ ID NO: 34148 - DNA, 15 bp, Homo sapiens
atgtaactgtttatt

SEQ ID NO: 34149 - DNA, 15 bp, Homo sapiens
gatgtaactgtttat

SEQ ID NO: 34150 - DNA, 15 bp, Homo sapiens
agatgtaactgttta

SEQ ID NO: 34151 - DNA, 15 bp, Homo sapiens
tagatgtaactgttt

SEQ ID NO: 34152 - DNA, 15 bp, Homo sapiens
ttagatgtaactgtt

SEQ ID NO: 34153 - DNA, 15 bp, Homo sapiens
cttagatgtaactgt

SEQ ID NO: 34154 - DNA, 15 bp, Homo sapiens
tcttagatgtaactg

SEQ ID NO: 34155 - DNA, 15 bp, Homo sapiens
atcttagatgtaact

SEQ ID NO: 34156 - DNA, 15 bp, Homo sapiens
catcttagatgtaac

SEQ ID NO: 34157 - DNA, 15 bp, Homo sapiens
tcatcttagatgtaa

SEQ ID NO: 34158 - DNA, 15 bp, Homo sapiens
atcatcttagatgta

SEQ ID NO: 34159 - DNA, 15 bp, Homo sapiens
aatcatcttagatgt

SEQ ID NO: 34160 - DNA, 15 bp, Homo sapiens
gaatcatcttagatg

SEQ ID NO: 34161 - DNA, 15 bp, Homo sapiens
agaatcatcttagat

SEQ ID NO: 34162 - DNA, 15 bp, Homo sapiens
cagaatcatcttaga

SEQ ID NO: 34163 - DNA, 15 bp, Homo sapiens
tcagaatcatcttag

SEQ ID NO: 34164 - DNA, 15 bp, Homo sapiens
ttcagaatcatctta

SEQ ID NO: 34165 - DNA, 15 bp, Homo sapiens
cttcagaatcatctt

SEQ ID NO: 34166 - DNA, 15 bp, Homo sapiens
ccttcagaatcatct

SEQ ID NO: 34167 - DNA, 15 bp, Homo sapiens
tccttcagaatcatc

SEQ ID NO: 34168 - DNA, 15 bp, Homo sapiens
gtccttcagaatcat

SEQ ID NO: 34169 - DNA, 15 bp, Homo sapiens
ggtccttcagaatca

SEQ ID NO: 34170 - DNA, 15 bp, Homo sapiens
tggtccttcagaatc

SEQ ID NO: 34171 - DNA, 15 bp, Homo sapiens
ctggtccttcagaat

SEQ ID NO: 34172 - DNA, 15 bp, Homo sapiens
cctggtccttcagaa

SEQ ID NO: 34173 - DNA, 15 bp, Homo sapiens
ccctggtccttcaga

SEQ ID NO: 34174 - DNA, 15 bp, Homo sapiens
gccctggtccttcag

SEQ ID NO: 34175 - DNA, 15 bp, Homo sapiens
agccctggtccttca

SEQ ID NO: 34176 - DNA, 15 bp, Homo sapiens
aagccctggtccttc

SEQ ID NO: 34177 - DNA, 15 bp, Homo sapiens
gaagccctggtcctt

SEQ ID NO: 34178 - DNA, 15 bp, Homo sapiens
agaagccctggtcct

SEQ ID NO: 34179 - DNA, 15 bp, Homo sapiens
gagaagccctggtcc

SEQ ID NO: 34180 - DNA, 15 bp, Homo sapiens
ggagaagccctggtc

SEQ ID NO: 34181 - DNA, 15 bp, Homo sapiens
cggagaagccctggt

SEQ ID NO: 34182 - DNA, 15 bp, Homo sapiens
tcggagaagccctgg

SEQ ID NO: 34183 - DNA, 15 bp, Homo sapiens
ctcggagaagccctg

SEQ ID NO: 34184 - DNA, 15 bp, Homo sapiens
tctcggagaagccct

SEQ ID NO: 34185 - DNA, 15 bp, Homo sapiens
ttctcggagaagccc

SEQ ID NO: 34186 - DNA, 15 bp, Homo sapiens
tttctcggagaagcc

SEQ ID NO: 34187 - DNA, 15 bp, Homo sapiens
atttctcggagaagc

SEQ ID NO: 34188 - DNA, 15 bp, Homo sapiens
aatttctcggagaag

SEQ ID NO: 34189 - DNA, 15 bp, Homo sapiens
caatttctcggagaa

SEQ ID NO: 34190 - DNA, 15 bp, Homo sapiens
ccaatttctcggaga

SEQ ID NO: 34191 - DNA, 15 bp, Homo sapiens
cccaatttctcggag

SEQ ID NO: 34192 - DNA, 15 bp, Homo sapiens
ccccaatttctcgga

SEQ ID NO: 34193 - DNA, 15 bp, Homo sapiens
accccaatttctcgg

SEQ ID NO: 34194 - DNA, 15 bp, Homo sapiens
taccccaatttctcg

SEQ ID NO: 34195 - DNA, 15 bp, Homo sapiens
ttaccccaatttctc

SEQ ID NO: 34196 - DNA, 15 bp, Homo sapiens
tttaccccaatttct

SEQ ID NO: 34197 - DNA, 15 bp, Homo sapiens
gtttaccccaatttc

SEQ ID NO: 34198 - DNA, 15 bp, Homo sapiens
ggtttaccccaattt

SEQ ID NO: 34199 - DNA, 15 bp, Homo sapiens
aggtttaccccaatt

SEQ ID NO: 34200 - DNA, 15 bp, Homo sapiens
gaggtttaccccaat

SEQ ID NO: 34201 - DNA, 15 bp, Homo sapiens
agaggtttaccccaa

SEQ ID NO: 34202 - DNA, 15 bp, Homo sapiens
aagaggtttacccca

SEQ ID NO: 34203 - DNA, 15 bp, Homo sapiens
caagaggtttacccc

SEQ ID NO: 34204 - DNA, 15 bp, Homo sapiens
ccaagaggtttaccc

SEQ ID NO: 34205 - DNA, 15 bp, Homo sapiens
gccaagaggtttacc

SEQ ID NO: 34206 - DNA, 15 bp, Homo sapiens
agccaagaggtttac

SEQ ID NO: 34207 - DNA, 15 bp, Homo sapiens
cagccaagaggttta

SEQ ID NO: 34208 - DNA, 15 bp, Homo sapiens
ccagccaagaggttt

SEQ ID NO: 34209 - DNA, 15 bp, Homo sapiens
gccagccaagaggtt

SEQ ID NO: 34210 - DNA, 15 bp, Homo sapiens
agccagccaagaggt

SEQ ID NO: 34211 - DNA, 15 bp, Homo sapiens
gagccagccaagagg

SEQ ID NO: 34212 - DNA, 15 bp, Homo sapiens
agagccagccaagag

SEQ ID NO: 34213 - DNA, 15 bp, Homo sapiens
cagagccagccaaga

SEQ ID NO: 34214 - DNA, 15 bp, Homo sapiens
gcagagccagccaag

SEQ ID NO: 34215 - DNA, 15 bp, Homo sapiens
tgcagagccagccaa

SEQ ID NO: 34216 - DNA, 15 bp, Homo sapiens
atgcagagccagcca

SEQ ID NO: 34217 - DNA, 15 bp, Homo sapiens
aatgcagagccagcc

SEQ ID NO: 34218 - DNA, 15 bp, Homo sapiens
gaatgcagagccagc

SEQ ID NO: 34219 - DNA, 15 bp, Homo sapiens
tgaatgcagagccag

SEQ ID NO: 34220 - DNA, 15 bp, Homo sapiens
ctgaatgcagagcca

SEQ ID NO: 34221 - DNA, 15 bp, Homo sapiens
cctgaatgcagagcc

SEQ ID NO: 34222 - DNA, 15 bp, Homo sapiens
gcctgaatgcagagc

SEQ ID NO: 34223 - DNA, 15 bp, Homo sapiens
agcctgaatgcagag

SEQ ID NO: 34224 - DNA, 15 bp, Homo sapiens
cagcctgaatgcaga

SEQ ID NO: 34225 - DNA, 15 bp, Homo sapiens
ccagcctgaatgcag

SEQ ID NO: 34226 - DNA, 15 bp, Homo sapiens
accagcctgaatgca

SEQ ID NO: 34227 - DNA, 15 bp, Homo sapiens
gaccagcctgaatgc

SEQ ID NO: 34228 - DNA, 15 bp, Homo sapiens
agaccagcctgaatg

SEQ ID NO: 34229 - DNA, 15 bp, Homo sapiens
cagaccagcctgaat

SEQ ID NO: 34230 - DNA, 15 bp, Homo sapiens
acagaccagcctgaa

SEQ ID NO: 34231 - DNA, 15 bp, Homo sapiens
cacagaccagcctga

SEQ ID NO: 34232 - DNA, 15 bp, Homo sapiens
gcacagaccagcctg

SEQ ID NO: 34233 - DNA, 15 bp, Homo sapiens
agcacagaccagcct

SEQ ID NO: 34234 - DNA, 15 bp, Homo sapiens
tagcacagaccagcc

SEQ ID NO: 34235 - DNA, 15 bp, Homo sapiens
ctagcacagaccagc

SEQ ID NO: 34236 - DNA, 15 bp, Homo sapiens
cctagcacagaccag

SEQ ID NO: 34237 - DNA, 15 bp, Homo sapiens
gcctagcacagacca

SEQ ID NO: 34238 - DNA, 15 bp, Homo sapiens
agcctagcacagacc

SEQ ID NO: 34239 - DNA, 15 bp, Homo sapiens
aagcctagcacagac

SEQ ID NO: 34240 - DNA, 15 bp, Homo sapiens
caagcctagcacaga

SEQ ID NO: 34241 - DNA, 15 bp, Homo sapiens
ccaagcctagcacag

SEQ ID NO: 34242 - DNA, 15 bp, Homo sapiens
accaagcctagcaca

SEQ ID NO: 34243 - DNA, 15 bp, Homo sapiens
taccaagcctagcac

SEQ ID NO: 34244 - DNA, 15 bp, Homo sapiens
ataccaagcctagca

SEQ ID NO: 34245 - DNA, 15 bp, Homo sapiens
cataccaagcctagc

SEQ ID NO: 34246 - DNA, 15 bp, Homo sapiens
ccataccaagcctag

SEQ ID NO: 34247 - DNA, 15 bp, Homo sapiens
cccataccaagccta

SEQ ID NO: 34248 - DNA, 15 bp, Homo sapiens
ccccataccaagcct

SEQ ID NO: 34249 - DNA, 15 bp, Homo sapiens
accccataccaagcc

SEQ ID NO: 34250 - DNA, 15 bp, Homo sapiens
aaccccataccaagc

SEQ ID NO: 34251 - DNA, 15 bp, Homo sapiens
caaccccataccaag

SEQ ID NO: 34252 - DNA, 15 bp, Homo sapiens
ccaaccccataccaa

SEQ ID NO: 34253 - DNA, 15 bp, Homo sapiens
tccaaccccatacca

SEQ ID NO: 34254 - DNA, 15 bp, Homo sapiens
ctccaaccccatacc

SEQ ID NO: 34255 - DNA, 15 bp, Homo sapiens
gctccaaccccatac

SEQ ID NO: 34256 - DNA, 15 bp, Homo sapiens
ggctccaaccccata

SEQ ID NO: 34257 - DNA, 15 bp, Homo sapiens
aggctccaaccccat

SEQ ID NO: 34258 - DNA, 15 bp, Homo sapiens
caggctccaacccca

SEQ ID NO: 34259 - DNA, 15 bp, Homo sapiens
ccaggctccaacccc

SEQ ID NO: 34260 - DNA, 15 bp, Homo sapiens
tccaggctccaaccc

SEQ ID NO: 34261 - DNA, 15 bp, Homo sapiens
gtccaggctccaacc

SEQ ID NO: 34262 - DNA, 15 bp, Homo sapiens
agtccaggctccaac

SEQ ID NO: 34263 - DNA, 15 bp, Homo sapiens
aagtccaggctccaa

SEQ ID NO: 34264 - DNA, 15 bp, Homo sapiens
caagtccaggctcca

SEQ ID NO: 34265 - DNA, 15 bp, Homo sapiens
ccaagtccaggctcc

SEQ ID NO: 34266 - DNA, 15 bp, Homo sapiens
cccaagtccaggctc

SEQ ID NO: 34267 - DNA, 15 bp, Homo sapiens
tcccaagtccaggct

SEQ ID NO: 34268 - DNA, 15 bp, Homo sapiens
ttcccaagtccaggc

SEQ ID NO: 34269 - DNA, 15 bp, Homo sapiens
tttcccaagtccagg

SEQ ID NO: 34270 - DNA, 15 bp, Homo sapiens
atttcccaagtccag

SEQ ID NO: 34271 - DNA, 15 bp, Homo sapiens
tatttcccaagtcca

SEQ ID NO: 34272 - DNA, 15 bp, Homo sapiens
atatttcccaagtcc

SEQ ID NO: 34273 - DNA, 15 bp, Homo sapiens
tatatttcccaagtc

SEQ ID NO: 34274 - DNA, 15 bp, Homo sapiens
gtatatttcccaagt

SEQ ID NO: 34275 - DNA, 15 bp, Homo sapiens
agtatatttcccaag

SEQ ID NO: 34276 - DNA, 15 bp, Homo sapiens
cagtatatttcccaa

SEQ ID NO: 34277 - DNA, 15 bp, Homo sapiens
ccagtatatttccca

SEQ ID NO: 34278 - DNA, 15 bp, Homo sapiens
cccagtatatttccc

SEQ ID NO: 34279 - DNA, 15 bp, Homo sapiens
gcccagtatatttcc

SEQ ID NO: 34280 - DNA, 15 bp, Homo sapiens
agcccagtatatttc

SEQ ID NO: 34281 - DNA, 15 bp, Homo sapiens
cagcccagtatattt

SEQ ID NO: 34282 - DNA, 15 bp, Homo sapiens
tcagcccagtatatt

SEQ ID NO: 34283 - DNA, 15 bp, Homo sapiens
atcagcccagtatat

SEQ ID NO: 34284 - DNA, 15 bp, Homo sapiens
tatcagcccagtata

SEQ ID NO: 34285 - DNA, 15 bp, Homo sapiens
ctatcagcccagtat

SEQ ID NO: 34286 - DNA, 15 bp, Homo sapiens
cctatcagcccagta

SEQ ID NO: 34287 - DNA, 15 bp, Homo sapiens
tcctatcagcccagt

SEQ ID NO: 34288 - DNA, 15 bp, Homo sapiens
ttcctatcagcccag

SEQ ID NO: 34289 - DNA, 15 bp, Homo sapiens
attcctatcagccca

SEQ ID NO: 34290 - DNA, 15 bp, Homo sapiens
aattcctatcagccc

SEQ ID NO: 34291 - DNA, 15 bp, Homo sapiens
aaattcctatcagcc

SEQ ID NO: 34292 - DNA, 15 bp, Homo sapiens
caaattcctatcagc

SEQ ID NO: 34293 - DNA, 15 bp, Homo sapiens
tcaaattcctatcag

SEQ ID NO: 34294 - DNA, 15 bp, Homo sapiens
atcaaattcctatca

SEQ ID NO: 34295 - DNA, 15 bp, Homo sapiens
aatcaaattcctatc

SEQ ID NO: 34296 - DNA, 15 bp, Homo sapiens
caatcaaattcctat

SEQ ID NO: 34297 - DNA, 15 bp, Homo sapiens
ccaatcaaattccta

SEQ ID NO: 34298 - DNA, 15 bp, Homo sapiens
tccaatcaaattcct

SEQ ID NO: 34299 - DNA, 15 bp, Homo sapiens
atccaatcaaattcc

SEQ ID NO: 34300 - DNA, 15 bp, Homo sapiens
aatccaatcaaattc

SEQ ID NO: 34301 - DNA, 15 bp, Homo sapiens
aaatccaatcaaatt

SEQ ID NO: 34302 - DNA, 15 bp, Homo sapiens
aaaatccaatcaaat

SEQ ID NO: 34303 - DNA, 15 bp, Homo sapiens
gaaaatccaatcaaa

SEQ ID NO: 34304 - DNA, 15 bp, Homo sapiens
agaaaatccaatcaa

SEQ ID NO: 34305 - DNA, 15 bp, Homo sapiens
aagaaaatccaatca

SEQ ID NO: 34306 - DNA, 15 bp, Homo sapiens
caagaaaatccaatc

SEQ ID NO: 34307 - DNA, 15 bp, Homo sapiens
gcaagaaaatccaat

SEQ ID NO: 34308 - DNA, 15 bp, Homo sapiens
tgcaagaaaatccaa

SEQ ID NO: 34309 - DNA, 15 bp, Homo sapiens
ctgcaagaaaatcca

SEQ ID NO: 34310 - DNA, 15 bp, Homo sapiens
tctgcaagaaaatcc

SEQ ID NO: 34311 - DNA, 15 bp, Homo sapiens
ctctgcaagaaaatc

SEQ ID NO: 34312 - DNA, 15 bp, Homo sapiens
actctgcaagaaaat

SEQ ID NO: 34313 - DNA, 15 bp, Homo sapiens
gactctgcaagaaaa

SEQ ID NO: 34314 - DNA, 15 bp, Homo sapiens
tgactctgcaagaaa

SEQ ID NO: 34315 - DNA, 15 bp, Homo sapiens
atgactctgcaagaa

SEQ ID NO: 34316 - DNA, 15 bp, Homo sapiens
aatgactctgcaaga

SEQ ID NO: 34317 - DNA, 15 bp, Homo sapiens
aaatgactctgcaag

SEQ ID NO: 34318 - DNA, 15 bp, Homo sapiens
gaaatgactctgcaa

SEQ ID NO: 34319 - DNA, 15 bp, Homo sapiens
ggaaatgactctgca

SEQ ID NO: 34320 - DNA, 15 bp, Homo sapiens
aggaaatgactctgc

SEQ ID NO: 34321 - DNA, 15 bp, Homo sapiens
taggaaatgactctg

SEQ ID NO: 34322 - DNA, 15 bp, Homo sapiens
gtaggaaatgactct

SEQ ID NO: 34323 - DNA, 15 bp, Homo sapiens
tgtaggaaatgactc

SEQ ID NO: 34324 - DNA, 15 bp, Homo sapiens
ctgtaggaaatgact

SEQ ID NO: 34325 - DNA, 15 bp, Homo sapiens
actgtaggaaatgac

SEQ ID NO: 34326 - DNA, 15 bp, Homo sapiens
cactgtaggaaatga

SEQ ID NO: 34327 - DNA, 15 bp, Homo sapiens
acactgtaggaaatg

SEQ ID NO: 34328 - DNA, 15 bp, Homo sapiens
tacactgtaggaaat

SEQ ID NO: 34329 - DNA, 15 bp, Homo sapiens
ttacactgtaggaaa

SEQ ID NO: 34330 - DNA, 15 bp, Homo sapiens
tttacactgtaggaa

SEQ ID NO: 34331 - DNA, 15 bp, Homo sapiens
ctttacactgtagga

SEQ ID NO: 34332 - DNA, 15 bp, Homo sapiens
tctttacactgtagg

SEQ ID NO: 34333 - DNA, 15 bp, Homo sapiens
ctctttacactgtag

SEQ ID NO: 34334 - DNA, 15 bp, Homo sapiens
cctctttacactgta

SEQ ID NO: 34335 - DNA, 15 bp, Homo sapiens
tcctctttacactgt

SEQ ID NO: 34336 - DNA, 15 bp, Homo sapiens
gtcctctttacactg

SEQ ID NO: 34337 - DNA, 15 bp, Homo sapiens
tgtcctctttacact

SEQ ID NO: 34338 - DNA, 15 bp, Homo sapiens
ttgtcctctttacac

SEQ ID NO: 34339 - DNA, 15 bp, Homo sapiens
gttgtcctctttaca

SEQ ID NO: 34340 - DNA, 15 bp, Homo sapiens
ggttgtcctctttac

SEQ ID NO: 34341 - DNA, 15 bp, Homo sapiens
gggttgtcctcttta

SEQ ID NO: 34342 - DNA, 15 bp, Homo sapiens
cgggttgtcctcttt

SEQ ID NO: 34343 - DNA, 15 bp, Homo sapiens
ccgggttgtcctctt

SEQ ID NO: 34344 - DNA, 15 bp, Homo sapiens
tccgggttgtcctct

SEQ ID NO: 34345 - DNA, 15 bp, Homo sapiens
gtccgggttgtcctc

SEQ ID NO: 34346 - DNA, 15 bp, Homo sapiens
agtccgggttgtcct

SEQ ID NO: 34347 - DNA, 15 bp, Homo sapiens
aagtccgggttgtcc

SEQ ID NO: 34348 - DNA, 15 bp, Homo sapiens
aaagtccgggttgtc

SEQ ID NO: 34349 - DNA, 15 bp, Homo sapiens
caaagtccgggttgt

SEQ ID NO: 34350 - DNA, 15 bp, Homo sapiens
tcaaagtccgggttg

SEQ ID NO: 34351 - DNA, 15 bp, Homo sapiens
ttcaaagtccgggtt

SEQ ID NO: 34352 - DNA, 15 bp, Homo sapiens
cttcaaagtccgggt

SEQ ID NO: 34353 - DNA, 15 bp, Homo sapiens
ccttcaaagtccggg

SEQ ID NO: 34354 - DNA, 15 bp, Homo sapiens
gccttcaaagtccgg

SEQ ID NO: 34355 - DNA, 15 bp, Homo sapiens
cgccttcaaagtccg

SEQ ID NO: 34356 - DNA, 15 bp, Homo sapiens
acgccttcaaagtcc

SEQ ID NO: 34357 - DNA, 15 bp, Homo sapiens
cacgccttcaaagtc

SEQ ID NO: 34358 - DNA, 15 bp, Homo sapiens
ccacgccttcaaagt

SEQ ID NO: 34359 - DNA, 15 bp, Homo sapiens
tccacgccttcaaag

SEQ ID NO: 34360 - DNA, 15 bp, Homo sapiens
atccacgccttcaaa

SEQ ID NO: 34361 - DNA, 15 bp, Homo sapiens
aatccacgccttcaa

SEQ ID NO: 34362 - DNA, 15 bp, Homo sapiens
caatccacgccttca

SEQ ID NO: 34363 - DNA, 15 bp, Homo sapiens
acaatccacgccttc

SEQ ID NO: 34364 - DNA, 15 bp, Homo sapiens
cacaatccacgcctt

SEQ ID NO: 34365 - DNA, 15 bp, Homo sapiens
gcacaatccacgcct

SEQ ID NO: 34366 - DNA, 15 bp, Homo sapiens
tgcacaatccacgcc

SEQ ID NO: 34367 - DNA, 15 bp, Homo sapiens
ttgcacaatccacgc

SEQ ID NO: 34368 - DNA, 15 bp, Homo sapiens
attgcacaatccacg

SEQ ID NO: 34369 - DNA, 15 bp, Homo sapiens
gattgcacaatccac

SEQ ID NO: 34370 - DNA, 15 bp, Homo sapiens
agattgcacaatcca

SEQ ID NO: 34371 - DNA, 15 bp, Homo sapiens
aagattgcacaatcc

SEQ ID NO: 34372 - DNA, 15 bp, Homo sapiens
aaagattgcacaatc

SEQ ID NO: 34373 - DNA, 15 bp, Homo sapiens
caaagattgcacaat

SEQ ID NO: 34374 - DNA, 15 bp, Homo sapiens
tcaaagattgcacaa

SEQ ID NO: 34375 - DNA, 15 bp, Homo sapiens
ttcaaagattgcaca

SEQ ID NO: 34376 - DNA, 15 bp, Homo sapiens
attcaaagattgcac

SEQ ID NO: 34377 - DNA, 15 bp, Homo sapiens
gattcaaagattgca

SEQ ID NO: 34378 - DNA, 15 bp, Homo sapiens
ggattcaaagattgc

SEQ ID NO: 34379 - DNA, 15 bp, Homo sapiens
gggattcaaagattg

SEQ ID NO: 34380 - DNA, 15 bp, Homo sapiens
ggggattcaaagatt

SEQ ID NO: 34381 - DNA, 15 bp, Homo sapiens
tggggattcaaagat

SEQ ID NO: 34382 - DNA, 15 bp, Homo sapiens
atggggattcaaaga

SEQ ID NO: 34383 - DNA, 15 bp, Homo sapiens
tatggggattcaaag

SEQ ID NO: 34384 - DNA, 15 bp, Homo sapiens
gtatggggattcaaa

SEQ ID NO: 34385 - DNA, 15 bp, Homo sapiens
ggtatggggattcaa

SEQ ID NO: 34386 - DNA, 15 bp, Homo sapiens
gggtatggggattca

SEQ ID NO: 34387 - DNA, 15 bp, Homo sapiens
cgggtatggggattc

SEQ ID NO: 34388 - DNA, 15 bp, Homo sapiens
tcgggtatggggatt

SEQ ID NO: 34389 - DNA, 15 bp, Homo sapiens
atcgggtatggggat

SEQ ID NO: 34390 - DNA, 15 bp, Homo sapiens
catcgggtatgggga

SEQ ID NO: 34391 - DNA, 15 bp, Homo sapiens
tcatcgggtatgggg

SEQ ID NO: 34392 - DNA, 15 bp, Homo sapiens
gtcatcgggtatggg

SEQ ID NO: 34393 - DNA, 15 bp, Homo sapiens
tgtcatcgggtatgg

SEQ ID NO: 34394 - DNA, 15 bp, Homo sapiens
ttgtcatcgggtatg

SEQ ID NO: 34395 - DNA, 15 bp, Homo sapiens
attgtcatcgggtat

SEQ ID NO: 34396 - DNA, 15 bp, Homo sapiens
cattgtcatcgggta

SEQ ID NO: 34397 - DNA, 15 bp, Homo sapiens
ccattgtcatcgggt

SEQ ID NO: 34398 - DNA, 15 bp, Homo sapiens
gccattgtcatcggg

SEQ ID NO: 34399 - DNA, 15 bp, Homo sapiens
cgccattgtcatcgg

SEQ ID NO: 34400 - DNA, 15 bp, Homo sapiens
gcgccattgtcatcg

SEQ ID NO: 34401 - DNA, 15 bp, Homo sapiens
agcgccattgtcatc

SEQ ID NO: 34402 - DNA, 15 bp, Homo sapiens
gagcgccattgtcat

SEQ ID NO: 34403 - DNA, 15 bp, Homo sapiens
agagcgccattgtca

SEQ ID NO: 34404 - DNA, 15 bp, Homo sapiens
gagagcgccattgtc

SEQ ID NO: 34405 - DNA, 15 bp, Homo sapiens
agagagcgccattgt

SEQ ID NO: 34406 - DNA, 15 bp, Homo sapiens
cagagagcgccattg

SEQ ID NO: 34407 - DNA, 15 bp, Homo sapiens
acagagagcgccatt

SEQ ID NO: 34408 - DNA, 15 bp, Homo sapiens
aacagagagcgccat

SEQ ID NO: 34409 - DNA, 15 bp, Homo sapiens
gaacagagagcgcca

SEQ ID NO: 34410 - DNA, 15 bp, Homo sapiens
agaacagagagcgcc

SEQ ID NO: 34411 - DNA, 15 bp, Homo sapiens
tagaacagagagcgc

SEQ ID NO: 34412 - DNA, 15 bp, Homo sapiens
ctagaacagagagcg

SEQ ID NO: 34413 - DNA, 15 bp, Homo sapiens
actagaacagagagc

SEQ ID NO: 34414 - DNA, 15 bp, Homo sapiens
tactagaacagagag

SEQ ID NO: 34415 - DNA, 15 bp, Homo sapiens
ttactagaacagaga

SEQ ID NO: 34416 - DNA, 15 bp, Homo sapiens
gttactagaacagag

SEQ ID NO: 34417 - DNA, 15 bp, Homo sapiens
agttactagaacaga

SEQ ID NO: 34418 - DNA, 15 bp, Homo sapiens
tagttactagaacag

SEQ ID NO: 34419 - DNA, 15 bp, Homo sapiens
atagttactagaaca

SEQ ID NO: 34420 - DNA, 15 bp, Homo sapiens
tatagttactagaac

SEQ ID NO: 34421 - DNA, 15 bp, Homo sapiens
ctatagttactagaa

SEQ ID NO: 34422 - DNA, 15 bp, Homo sapiens
tctatagttactaga

SEQ ID NO: 34423 - DNA, 15 bp, Homo sapiens
ttctatagttactag

SEQ ID NO: 34424 - DNA, 15 bp, Homo sapiens
tttctatagttacta

SEQ ID NO: 34425 - DNA, 15 bp, Homo sapiens
atttctatagttact

SEQ ID NO: 34426 - DNA, 15 bp, Homo sapiens
catttctatagttac

SEQ ID NO: 34427 - DNA, 15 bp, Homo sapiens
acatttctatagtta

SEQ ID NO: 34428 - DNA, 15 bp, Homo sapiens
cacatttctatagtt

SEQ ID NO: 34429 - DNA, 15 bp, Homo sapiens
acacatttctatagt

SEQ ID NO: 34430 - DNA, 15 bp, Homo sapiens
tacacatttctatag

SEQ ID NO: 34431 - DNA, 15 bp, Homo sapiens
ttacacatttctata

SEQ ID NO: 34432 - DNA, 15 bp, Homo sapiens
gttacacatttctat

SEQ ID NO: 34433 - DNA, 15 bp, Homo sapiens
cgttacacatttcta

SEQ ID NO: 34434 - DNA, 15 bp, Homo sapiens
gcgttacacatttct

SEQ ID NO: 34435 - DNA, 15 bp, Homo sapiens
ggcgttacacatttc

SEQ ID NO: 34436 - DNA, 15 bp, Homo sapiens
gggcgttacacattt

SEQ ID NO: 34437 - DNA, 15 bp, Homo sapiens
agggcgttacacatt

SEQ ID NO: 34438 - DNA, 15 bp, Homo sapiens
gagggcgttacacat

SEQ ID NO: 34439 - DNA, 15 bp, Homo sapiens
tgagggcgttacaca

SEQ ID NO: 34440 - DNA, 15 bp, Homo sapiens
ttgagggcgttacac

SEQ ID NO: 34441 - DNA, 15 bp, Homo sapiens
gttgagggcgttaca

SEQ ID NO: 34442 - DNA, 15 bp, Homo sapiens
tgttgagggcgttac

SEQ ID NO: 34443 - DNA, 15 bp, Homo sapiens
ctgttgagggcgtta

SEQ ID NO: 34444 - DNA, 15 bp, Homo sapiens
cctgttgagggcgtt

SEQ ID NO: 34445 - DNA, 15 bp, Homo sapiens
acctgttgagggcgt

SEQ ID NO: 34446 - DNA, 15 bp, Homo sapiens
aacctgttgagggcg

SEQ ID NO: 34447 - DNA, 15 bp, Homo sapiens
taacctgttgagggc

SEQ ID NO: 34448 - DNA, 15 bp, Homo sapiens
ctaacctgttgaggg

SEQ ID NO: 34449 - DNA, 15 bp, Homo sapiens
actaacctgttgagg

SEQ ID NO: 34450 - DNA, 15 bp, Homo sapiens
cactaacctgttgag

SEQ ID NO: 34451 - DNA, 15 bp, Homo sapiens
gcactaacctgttga

SEQ ID NO: 34452 - DNA, 15 bp, Homo sapiens
tgcactaacctgttg

SEQ ID NO: 34453 - DNA, 15 bp, Homo sapiens
gtgcactaacctgtt

SEQ ID NO: 34454 - DNA, 15 bp, Homo sapiens
ggtgcactaacctgt

SEQ ID NO: 34455 - DNA, 15 bp, Homo sapiens
aggtgcactaacctg

SEQ ID NO: 34456 - DNA, 15 bp, Homo sapiens
aaggtgcactaacct

SEQ ID NO: 34457 - DNA, 15 bp, Homo sapiens
gaaggtgcactaacc

SEQ ID NO: 34458 - DNA, 15 bp, Homo sapiens
tgaaggtgcactaac

SEQ ID NO: 34459 - DNA, 15 bp, Homo sapiens
gtgaaggtgcactaa

SEQ ID NO: 34460 - DNA, 15 bp, Homo sapiens
cgtgaaggtgcacta

SEQ ID NO: 34461 - DNA, 15 bp, Homo sapiens
ccgtgaaggtgcact

SEQ ID NO: 34462 - DNA, 15 bp, Homo sapiens
gccgtgaaggtgcac

SEQ ID NO: 34463 - DNA, 15 bp, Homo sapiens
tgccgtgaaggtgca

SEQ ID NO: 34464 - DNA, 15 bp, Homo sapiens
ctgccgtgaaggtgc

SEQ ID NO: 34465 - DNA, 15 bp, Homo sapiens
cctgccgtgaaggtg

SEQ ID NO: 34466 - DNA, 15 bp, Homo sapiens
gcctgccgtgaaggt

SEQ ID NO: 34467 - DNA, 15 bp, Homo sapiens
agcctgccgtgaagg

SEQ ID NO: 34468 - DNA, 15 bp, Homo sapiens
cagcctgccgtgaag

SEQ ID NO: 34469 - DNA, 15 bp, Homo sapiens
tcagcctgccgtgaa

SEQ ID NO: 34470 - DNA, 15 bp, Homo sapiens
ctcagcctgccgtga

SEQ ID NO: 34471 - DNA, 15 bp, Homo sapiens
cctcagcctgccgtg

SEQ ID NO: 34472 - DNA, 15 bp, Homo sapiens
gcctcagcctgccgt

SEQ ID NO: 34473 - DNA, 15 bp, Homo sapiens
cgcctcagcctgccg

SEQ ID NO: 34474 - DNA, 15 bp, Homo sapiens
tcgcctcagcctgcc

SEQ ID NO: 34475 - DNA, 15 bp, Homo sapiens
ctcgcctcagcctgc

SEQ ID NO: 34476 - DNA, 15 bp, Homo sapiens
gctcgcctcagcctg

SEQ ID NO: 34477 - DNA, 15 bp, Homo sapiens
tgctcgcctcagcct

SEQ ID NO: 34478 - DNA, 15 bp, Homo sapiens
atgctcgcctcagcc

SEQ ID NO: 34479 - DNA, 15 bp, Homo sapiens
catgctcgcctcagc

SEQ ID NO: 34480 - DNA, 15 bp, Homo sapiens
ccatgctcgcctcag

SEQ ID NO: 34481 - DNA, 15 bp, Homo sapiens
accatgctcgcctca

SEQ ID NO: 34482 - DNA, 15 bp, Homo sapiens
caccatgctcgcctc

SEQ ID NO: 34483 - DNA, 15 bp, Homo sapiens
tcaccatgctcgcct

SEQ ID NO: 34484 - DNA, 15 bp, Homo sapiens
gtcaccatgctcgcc

SEQ ID NO: 34485 - DNA, 15 bp, Homo sapiens
agtcaccatgctcgc

SEQ ID NO: 34486 - DNA, 15 bp, Homo sapiens
cagtcaccatgctcg

SEQ ID NO: 34487 - DNA, 15 bp, Homo sapiens
gcagtcaccatgctc

SEQ ID NO: 34488 - DNA, 15 bp, Homo sapiens
ggcagtcaccatgct

SEQ ID NO: 34489 - DNA, 15 bp, Homo sapiens
tggcagtcaccatgc

SEQ ID NO: 34490 - DNA, 15 bp, Homo sapiens
ctggcagtcaccatg

SEQ ID NO: 34491 - DNA, 15 bp, Homo sapiens
cctggcagtcaccat

SEQ ID NO: 34492 - DNA, 15 bp, Homo sapiens
ccctggcagtcacca

SEQ ID NO: 34493 - DNA, 15 bp, Homo sapiens
gccctggcagtcacc

SEQ ID NO: 34494 - DNA, 15 bp, Homo sapiens
tgccctggcagtcac

SEQ ID NO: 34495 - DNA, 15 bp, Homo sapiens
gtgccctggcagtca

SEQ ID NO: 34496 - DNA, 15 bp, Homo sapiens
ggtgccctggcagtc

SEQ ID NO: 34497 - DNA, 15 bp, Homo sapiens
cggtgccctggcagt

SEQ ID NO: 34498 - DNA, 15 bp, Homo sapiens
ccggtgccctggcag

SEQ ID NO: 34499 - DNA, 15 bp, Homo sapiens
cccggtgccctggca

SEQ ID NO: 34500 - DNA, 15 bp, Homo sapiens
ccccggtgccctggc

SEQ ID NO: 34501 - DNA, 15 bp, Homo sapiens
tccccggtgccctgg

SEQ ID NO: 34502 - DNA, 15 bp, Homo sapiens
ttccccggtgccctg

SEQ ID NO: 34503 - DNA, 15 bp, Homo sapiens
attccccggtgccct

SEQ ID NO: 34504 - DNA, 15 bp, Homo sapiens
aattccccggtgccc

SEQ ID NO: 34505 - DNA, 15 bp, Homo sapiens
caattccccggtgcc

SEQ ID NO: 34506 - DNA, 15 bp, Homo sapiens
acaattccccggtgc

SEQ ID NO: 34507 - DNA, 15 bp, Homo sapiens
cacaattccccggtg

SEQ ID NO: 34508 - DNA, 15 bp, Homo sapiens
acacaattccccggt

SEQ ID NO: 34509 - DNA, 15 bp, Homo sapiens
cacacaattccccgg

SEQ ID NO: 34510 - DNA, 15 bp, Homo sapiens
acacacaattccccg

SEQ ID NO: 34511 - DNA, 15 bp, Homo sapiens
tacacacaattcccc

SEQ ID NO: 34512 - DNA, 15 bp, Homo sapiens
ctacacacaattccc

SEQ ID NO: 34513 - DNA, 15 bp, Homo sapiens
actacacacaattcc

SEQ ID NO: 34514 - DNA, 15 bp, Homo sapiens
gactacacacaattc

SEQ ID NO: 34515 - DNA, 15 bp, Homo sapiens
tgactacacacaatt

SEQ ID NO: 34516 - DNA, 15 bp, Homo sapiens
gtgactacacacaat

SEQ ID NO: 34517 - DNA, 15 bp, Homo sapiens
cgtgactacacacaa

SEQ ID NO: 34518 - DNA, 15 bp, Homo sapiens
ccgtgactacacaca

SEQ ID NO: 34519 - DNA, 15 bp, Homo sapiens
accgtgactacacac

SEQ ID NO: 34520 - DNA, 15 bp, Homo sapiens
aaccgtgactacaca

SEQ ID NO: 34521 - DNA, 15 bp, Homo sapiens
caaccgtgactacac

SEQ ID NO: 34522 - DNA, 15 bp, Homo sapiens
tcaaccgtgactaca

SEQ ID NO: 34523 - DNA, 15 bp, Homo sapiens
atcaaccgtgactac

SEQ ID NO: 34524 - DNA, 15 bp, Homo sapiens
aatcaaccgtgacta

SEQ ID NO: 34525 - DNA, 15 bp, Homo sapiens
caatcaaccgtgact

SEQ ID NO: 34526 - DNA, 15 bp, Homo sapiens
tcaatcaaccgtgac

SEQ ID NO: 34527 - DNA, 15 bp, Homo sapiens
ctcaatcaaccgtga

SEQ ID NO: 34528 - DNA, 15 bp, Homo sapiens
cctcaatcaaccgtg

SEQ ID NO: 34529 - DNA, 15 bp, Homo sapiens
tcctcaatcaaccgt

SEQ ID NO: 34530 - DNA, 15 bp, Homo sapiens
atcctcaatcaaccg

SEQ ID NO: 34531 - DNA, 15 bp, Homo sapiens
gatcctcaatcaacc

SEQ ID NO: 34532 - DNA, 15 bp, Homo sapiens
tgatcctcaatcaac

SEQ ID NO: 34533 - DNA, 15 bp, Homo sapiens
gtgatcctcaatcaa

SEQ ID NO: 34534 - DNA, 15 bp, Homo sapiens
tgtgatcctcaatca

SEQ ID NO: 34535 - DNA, 15 bp, Homo sapiens
ctgtgatcctcaatc

SEQ ID NO: 34536 - DNA, 15 bp, Homo sapiens
cctgtgatcctcaat

SEQ ID NO: 34537 - DNA, 15 bp, Homo sapiens
tcctgtgatcctcaa

SEQ ID NO: 34538 - DNA, 15 bp, Homo sapiens
gtcctgtgatcctca

SEQ ID NO: 34539 - DNA, 15 bp, Homo sapiens
tgtcctgtgatcctc

SEQ ID NO: 34540 - DNA, 15 bp, Homo sapiens
ctgtcctgtgatcct

SEQ ID NO: 34541 - DNA, 15 bp, Homo sapiens
actgtcctgtgatcc

SEQ ID NO: 34542 - DNA, 15 bp, Homo sapiens
aactgtcctgtgatc

SEQ ID NO: 34543 - DNA, 15 bp, Homo sapiens
gaactgtcctgtgat

SEQ ID NO: 34544 - DNA, 15 bp, Homo sapiens
agaactgtcctgtga

SEQ ID NO: 34545 - DNA, 15 bp, Homo sapiens
aagaactgtcctgtg

SEQ ID NO: 34546 - DNA, 15 bp, Homo sapiens
gaagaactgtcctgt

SEQ ID NO: 34547 - DNA, 15 bp, Homo sapiens
ggaagaactgtcctg

SEQ ID NO: 34548 - DNA, 15 bp, Homo sapiens
gggaagaactgtcct

SEQ ID NO: 34549 - DNA, 15 bp, Homo sapiens
agggaagaactgtcc

SEQ ID NO: 34550 - DNA, 15 bp, Homo sapiens
aagggaagaactgtc

SEQ ID NO: 34551 - DNA, 15 bp, Homo sapiens
gaagggaagaactgt

SEQ ID NO: 34552 - DNA, 15 bp, Homo sapiens
ggaagggaagaactg

SEQ ID NO: 34553 - DNA, 15 bp, Homo sapiens
gggaagggaagaact

SEQ ID NO: 34554 - DNA, 15 bp, Homo sapiens
tgggaagggaagaac

SEQ ID NO: 34555 - DNA, 15 bp, Homo sapiens
ttgggaagggaagaa

SEQ ID NO: 34556 - DNA, 15 bp, Homo sapiens
tttgggaagggaaga

SEQ ID NO: 34557 - DNA, 15 bp, Homo sapiens
ttttgggaagggaag

SEQ ID NO: 34558 - DNA, 15 bp, Homo sapiens
cttttgggaagggaa

SEQ ID NO: 34559 - DNA, 15 bp, Homo sapiens
tcttttgggaaggga

SEQ ID NO: 34560 - DNA, 15 bp, Homo sapiens
ttcttttgggaaggg

SEQ ID NO: 34561 - DNA, 15 bp, Homo sapiens
tttcttttgggaagg

SEQ ID NO: 34562 - DNA, 15 bp, Homo sapiens
ctttcttttgggaag

SEQ ID NO: 34563 - DNA, 15 bp, Homo sapiens
cctttcttttgggaa

SEQ ID NO: 34564 - DNA, 15 bp, Homo sapiens
tcctttcttttggga

SEQ ID NO: 34565 - DNA, 15 bp, Homo sapiens
ctcctttcttttggg

SEQ ID NO: 34566 - DNA, 15 bp, Homo sapiens
tctcctttcttttgg

SEQ ID NO: 34567 - DNA, 15 bp, Homo sapiens
ttctcctttcttttg

SEQ ID NO: 34568 - DNA, 15 bp, Homo sapiens
gttctcctttctttt

SEQ ID NO: 34569 - DNA, 15 bp, Homo sapiens
tgttctcctttcttt

SEQ ID NO: 34570 - DNA, 15 bp, Homo sapiens
ctgttctcctttctt

SEQ ID NO: 34571 - DNA, 15 bp, Homo sapiens
cctgttctcctttct

SEQ ID NO: 34572 - DNA, 15 bp, Homo sapiens
gcctgttctcctttc

SEQ ID NO: 34573 - DNA, 15 bp, Homo sapiens
tgcctgttctccttt

SEQ ID NO: 34574 - DNA, 15 bp, Homo sapiens
ttgcctgttctcctt

SEQ ID NO: 34575 - DNA, 15 bp, Homo sapiens
attgcctgttctcct

SEQ ID NO: 34576 - DNA, 15 bp, Homo sapiens
tattgcctgttctcc

SEQ ID NO: 34577 - DNA, 15 bp, Homo sapiens
gtattgcctgttctc

SEQ ID NO: 34578 - DNA, 15 bp, Homo sapiens
ggtattgcctgttct

SEQ ID NO: 34579 - DNA, 15 bp, Homo sapiens
tggtattgcctgttc

SEQ ID NO: 34580 - DNA, 15 bp, Homo sapiens
ctggtattgcctgtt

SEQ ID NO: 34581 - DNA, 15 bp, Homo sapiens
actggtattgcctgt

SEQ ID NO: 34582 - DNA, 15 bp, Homo sapiens
aactggtattgcctg

SEQ ID NO: 34583 - DNA, 15 bp, Homo sapiens
aaactggtattgcct

SEQ ID NO: 34584 - DNA, 15 bp, Homo sapiens
aaaactggtattgcc

SEQ ID NO: 34585 - DNA, 15 bp, Homo sapiens
taaaactggtattgc

SEQ ID NO: 34586 - DNA, 15 bp, Homo sapiens
ttaaaactggtattg

SEQ ID NO: 34587 - DNA, 15 bp, Homo sapiens
tttaaaactggtatt

SEQ ID NO: 34588 - DNA, 15 bp, Homo sapiens
ttttaaaactggtat

SEQ ID NO: 34589 - DNA, 15 bp, Homo sapiens
cttttaaaactggta

SEQ ID NO: 34590 - DNA, 15 bp, Homo sapiens
gcttttaaaactggt

SEQ ID NO: 34591 - DNA, 15 bp, Homo sapiens
tgcttttaaaactgg

SEQ ID NO: 34592 - DNA, 15 bp, Homo sapiens
atgcttttaaaactg

SEQ ID NO: 34593 - DNA, 15 bp, Homo sapiens
catgcttttaaaact

SEQ ID NO: 34594 - DNA, 15 bp, Homo sapiens
tcatgcttttaaaac

SEQ ID NO: 34595 - DNA, 15 bp, Homo sapiens
ctcatgcttttaaaa

SEQ ID NO: 34596 - DNA, 15 bp, Homo sapiens
gctcatgcttttaaa

SEQ ID NO: 34597 - DNA, 15 bp, Homo sapiens
agctcatgcttttaa

SEQ ID NO: 34598 - DNA, 15 bp, Homo sapiens
cagctcatgctttta

SEQ ID NO: 34599 - DNA, 15 bp, Homo sapiens
acagctcatgctttt

SEQ ID NO: 34600 - DNA, 15 bp, Homo sapiens
gacagctcatgcttt

SEQ ID NO: 34601 - DNA, 15 bp, Homo sapiens
cgacagctcatgctt

SEQ ID NO: 34602 - DNA, 15 bp, Homo sapiens
acgacagctcatgct

SEQ ID NO: 34603 - DNA, 15 bp, Homo sapiens
gacgacagctcatgc

SEQ ID NO: 34604 - DNA, 15 bp, Homo sapiens
tgacgacagctcatg

SEQ ID NO: 34605 - DNA, 15 bp, Homo sapiens
gtgacgacagctcat

SEQ ID NO: 34606 - DNA, 15 bp, Homo sapiens
ggtgacgacagctca

SEQ ID NO: 34607 - DNA, 15 bp, Homo sapiens
aggtgacgacagctc

SEQ ID NO: 34608 - DNA, 15 bp, Homo sapiens
gaggtgacgacagct

SEQ ID NO: 34609 - DNA, 15 bp, Homo sapiens
ggaggtgacgacagc

SEQ ID NO: 34610 - DNA, 15 bp, Homo sapiens
tggaggtgacgacag

SEQ ID NO: 34611 - DNA, 15 bp, Homo sapiens
ctggaggtgacgaca

SEQ ID NO: 34612 - DNA, 15 bp, Homo sapiens
cctggaggtgacgac

SEQ ID NO: 34613 - DNA, 15 bp, Homo sapiens
tcctggaggtgacga

SEQ ID NO: 34614 - DNA, 15 bp, Homo sapiens
ttcctggaggtgacg

SEQ ID NO: 34615 - DNA, 15 bp, Homo sapiens
cttcctggaggtgac

SEQ ID NO: 34616 - DNA, 15 bp, Homo sapiens
acttcctggaggtga

SEQ ID NO: 34617 - DNA, 15 bp, Homo sapiens
tacttcctggaggtg

SEQ ID NO: 34618 - DNA, 15 bp, Homo sapiens
ctacttcctggaggt

SEQ ID NO: 34619 - DNA, 15 bp, Homo sapiens
actacttcctggagg

SEQ ID NO: 34620 - DNA, 15 bp, Homo sapiens
cactacttcctggag

SEQ ID NO: 34621 - DNA, 15 bp, Homo sapiens
ccactacttcctgga

SEQ ID NO: 34622 - DNA, 15 bp, Homo sapiens
cccactacttcctgg

SEQ ID NO: 34623 - DNA, 15 bp, Homo sapiens
tcccactacttcctg

SEQ ID NO: 34624 - DNA, 15 bp, Homo sapiens
ctcccactacttcct

SEQ ID NO: 34625 - DNA, 15 bp, Homo sapiens
actcccactacttcc

SEQ ID NO: 34626 - DNA, 15 bp, Homo sapiens
cactcccactacttc

SEQ ID NO: 34627 - DNA, 15 bp, Homo sapiens
gcactcccactactt

SEQ ID NO: 34628 - DNA, 15 bp, Homo sapiens
agcactcccactact

SEQ ID NO: 34629 - DNA, 15 bp, Homo sapiens
aagcactcccactac

SEQ ID NO: 34630 - DNA, 15 bp, Homo sapiens
taagcactcccacta

SEQ ID NO: 34631 - DNA, 15 bp, Homo sapiens
ctaagcactcccact

SEQ ID NO: 34632 - DNA, 15 bp, Homo sapiens
gctaagcactcccac

SEQ ID NO: 34633 - DNA, 15 bp, Homo sapiens
ggctaagcactccca

SEQ ID NO: 34634 - DNA, 15 bp, Homo sapiens
gggctaagcactccc

SEQ ID NO: 34635 - DNA, 15 bp, Homo sapiens
agggctaagcactcc

SEQ ID NO: 34636 - DNA, 15 bp, Homo sapiens
cagggctaagcactc

SEQ ID NO: 34637 - DNA, 15 bp, Homo sapiens
acagggctaagcact

SEQ ID NO: 34638 - DNA, 15 bp, Homo sapiens
cacagggctaagcac

SEQ ID NO: 34639 - DNA, 15 bp, Homo sapiens
acacagggctaagca

SEQ ID NO: 34640 - DNA, 15 bp, Homo sapiens
aacacagggctaagc

SEQ ID NO: 34641 - DNA, 15 bp, Homo sapiens
aaacacagggctaag

SEQ ID NO: 34642 - DNA, 15 bp, Homo sapiens
gaaacacagggctaa

SEQ ID NO: 34643 - DNA, 15 bp, Homo sapiens
agaaacacagggcta

SEQ ID NO: 34644 - DNA, 15 bp, Homo sapiens
aagaaacacagggct

SEQ ID NO: 34645 - DNA, 15 bp, Homo sapiens
taagaaacacagggc

SEQ ID NO: 34646 - DNA, 15 bp, Homo sapiens
ctaagaaacacaggg

SEQ ID NO: 34647 - DNA, 15 bp, Homo sapiens
cctaagaaacacagg

SEQ ID NO: 34648 - DNA, 15 bp, Homo sapiens
tcctaagaaacacag

SEQ ID NO: 34649 - DNA, 15 bp, Homo sapiens
ctcctaagaaacaca

SEQ ID NO: 34650 - DNA, 15 bp, Homo sapiens
gctcctaagaaacac

SEQ ID NO: 34651 - DNA, 15 bp, Homo sapiens
agctcctaagaaaca

SEQ ID NO: 34652 - DNA, 15 bp, Homo sapiens
gagctcctaagaaac

SEQ ID NO: 34653 - DNA, 15 bp, Homo sapiens
agagctcctaagaaa

SEQ ID NO: 34654 - DNA, 15 bp, Homo sapiens
aagagctcctaagaa

SEQ ID NO: 34655 - DNA, 15 bp, Homo sapiens
gaagagctcctaaga

SEQ ID NO: 34656 - DNA, 15 bp, Homo sapiens
ggaagagctcctaag

SEQ ID NO: 34657 - DNA, 15 bp, Homo sapiens
aggaagagctcctaa

SEQ ID NO: 34658 - DNA, 15 bp, Homo sapiens
aaggaagagctccta

SEQ ID NO: 34659 - DNA, 15 bp, Homo sapiens
taaggaagagctcct

SEQ ID NO: 34660 - DNA, 15 bp, Homo sapiens
ttaaggaagagctcc

SEQ ID NO: 34661 - DNA, 15 bp, Homo sapiens
tttaaggaagagctc

SEQ ID NO: 34662 - DNA, 15 bp, Homo sapiens
ttttaaggaagagct

SEQ ID NO: 34663 - DNA, 15 bp, Homo sapiens
cttttaaggaagagc

SEQ ID NO: 34664 - DNA, 15 bp, Homo sapiens
tcttttaaggaagag

SEQ ID NO: 34665 - DNA, 15 bp, Homo sapiens
ttcttttaaggaaga

SEQ ID NO: 34666 - DNA, 15 bp, Homo sapiens
tttcttttaaggaag

SEQ ID NO: 34667 - DNA, 15 bp, Homo sapiens
gtttcttttaaggaa

SEQ ID NO: 34668 - DNA, 15 bp, Homo sapiens
ggtttcttttaagga

SEQ ID NO: 34669 - DNA, 15 bp, Homo sapiens
cggtttcttttaagg

SEQ ID NO: 34670 - DNA, 15 bp, Homo sapiens
acggtttcttttaag

SEQ ID NO: 34671 - DNA, 15 bp, Homo sapiens
cacggtttcttttaa

SEQ ID NO: 34672 - DNA, 15 bp, Homo sapiens
ccacggtttctttta

SEQ ID NO: 34673 - DNA, 15 bp, Homo sapiens
cccacggtttctttt

SEQ ID NO: 34674 - DNA, 15 bp, Homo sapiens
ccccacggtttcttt

SEQ ID NO: 34675 - DNA, 15 bp, Homo sapiens
cccccacggtttctt

SEQ ID NO: 34676 - DNA, 15 bp, Homo sapiens
gcccccacggtttct

SEQ ID NO: 34677 - DNA, 15 bp, Homo sapiens
ggcccccacggtttc

SEQ ID NO: 34678 - DNA, 15 bp, Homo sapiens
tggcccccacggttt

SEQ ID NO: 34679 - DNA, 15 bp, Homo sapiens
ttggcccccacggtt

SEQ ID NO: 34680 - DNA, 15 bp, Homo sapiens
tttggcccccacggt

SEQ ID NO: 34681 - DNA, 15 bp, Homo sapiens
ttttggcccccacgg

SEQ ID NO: 34682 - DNA, 15 bp, Homo sapiens
tttttggcccccacg

SEQ ID NO: 34683 - DNA, 15 bp, Homo sapiens
atttttggcccccac

SEQ ID NO: 34684 - DNA, 15 bp, Homo sapiens
tatttttggccccca

SEQ ID NO: 34685 - DNA, 15 bp, Homo sapiens
ctatttttggccccc

SEQ ID NO: 34686 - DNA, 15 bp, Homo sapiens
cctatttttggcccc

SEQ ID NO: 34687 - DNA, 15 bp, Homo sapiens
tcctatttttggccc

SEQ ID NO: 34688 - DNA, 15 bp, Homo sapiens
ttcctatttttggcc

SEQ ID NO: 34689 - DNA, 15 bp, Homo sapiens
gttcctatttttggc

SEQ ID NO: 34690 - DNA, 15 bp, Homo sapiens
agttcctatttttgg

SEQ ID NO: 34691 - DNA, 15 bp, Homo sapiens
aagttcctatttttg

SEQ ID NO: 34692 - DNA, 15 bp, Homo sapiens
aaagttcctattttt

SEQ ID NO: 34693 - DNA, 15 bp, Homo sapiens
caaagttcctatttt

SEQ ID NO: 34694 - DNA, 15 bp, Homo sapiens
ccaaagttcctattt

SEQ ID NO: 34695 - DNA, 15 bp, Homo sapiens
accaaagttcctatt

SEQ ID NO: 34696 - DNA, 15 bp, Homo sapiens
taccaaagttcctat

SEQ ID NO: 34697 - DNA, 15 bp, Homo sapiens
gtaccaaagttccta

SEQ ID NO: 34698 - DNA, 15 bp, Homo sapiens
ggtaccaaagttcct

SEQ ID NO: 34699 - DNA, 15 bp, Homo sapiens
gggtaccaaagttcc

SEQ ID NO: 34700 - DNA, 15 bp, Homo sapiens
ggggtaccaaagttc

SEQ ID NO: 34701 - DNA, 15 bp, Homo sapiens
aggggtaccaaagtt

SEQ ID NO: 34702 - DNA, 15 bp, Homo sapiens
caggggtaccaaagt

SEQ ID NO: 34703 - DNA, 15 bp, Homo sapiens
acaggggtaccaaag

SEQ ID NO: 34704 - DNA, 15 bp, Homo sapiens
tacaggggtaccaaa

SEQ ID NO: 34705 - DNA, 15 bp, Homo sapiens
atacaggggtaccaa

SEQ ID NO: 34706 - DNA, 15 bp, Homo sapiens
catacaggggtacca

SEQ ID NO: 34707 - DNA, 15 bp, Homo sapiens
gcatacaggggtacc

SEQ ID NO: 34708 - DNA, 15 bp, Homo sapiens
ggcatacaggggtac

SEQ ID NO: 34709 - DNA, 15 bp, Homo sapiens
tggcatacaggggta

SEQ ID NO: 34710 - DNA, 15 bp, Homo sapiens
ctggcatacaggggt

SEQ ID NO: 34711 - DNA, 15 bp, Homo sapiens
gctggcatacagggg

SEQ ID NO: 34712 - DNA, 15 bp, Homo sapiens
tgctggcatacaggg

SEQ ID NO: 34713 - DNA, 15 bp, Homo sapiens
gtgctggcatacagg

SEQ ID NO: 34714 - DNA, 15 bp, Homo sapiens
ggtgctggcatacag

SEQ ID NO: 34715 - DNA, 15 bp, Homo sapiens
gggtgctggcataca

SEQ ID NO: 34716 - DNA, 15 bp, Homo sapiens
tgggtgctggcatac

SEQ ID NO: 34717 - DNA, 15 bp, Homo sapiens
gtgggtgctggcata

SEQ ID NO: 34718 - DNA, 15 bp, Homo sapiens
tgtgggtgctggcat

SEQ ID NO: 34719 - DNA, 15 bp, Homo sapiens
ctgtgggtgctggca

SEQ ID NO: 34720 - DNA, 15 bp, Homo sapiens
cctgtgggtgctggc

SEQ ID NO: 34721 - DNA, 15 bp, Homo sapiens
ccctgtgggtgctgg

SEQ ID NO: 34722 - DNA, 15 bp, Homo sapiens
tccctgtgggtgctg

SEQ ID NO: 34723 - DNA, 15 bp, Homo sapiens
ttccctgtgggtgct

SEQ ID NO: 34724 - DNA, 15 bp, Homo sapiens
cttccctgtgggtgc

SEQ ID NO: 34725 - DNA, 15 bp, Homo sapiens
ccttccctgtgggtg

SEQ ID NO: 34726 - DNA, 15 bp, Homo sapiens
tccttccctgtgggt

SEQ ID NO: 34727 - DNA, 15 bp, Homo sapiens
ttccttccctgtggg

SEQ ID NO: 34728 - DNA, 15 bp, Homo sapiens
gttccttccctgtgg

SEQ ID NO: 34729 - DNA, 15 bp, Homo sapiens
ggttccttccctgtg

SEQ ID NO: 34730 - DNA, 15 bp, Homo sapiens
aggttccttccctgt

SEQ ID NO: 34731 - DNA, 15 bp, Homo sapiens
gaggttccttccctg

SEQ ID NO: 34732 - DNA, 15 bp, Homo sapiens
tgaggttccttccct

SEQ ID NO: 34733 - DNA, 15 bp, Homo sapiens
gtgaggttccttccc

SEQ ID NO: 34734 - DNA, 15 bp, Homo sapiens
ggtgaggttccttcc

SEQ ID NO: 34735 - DNA, 15 bp, Homo sapiens
gggtgaggttccttc

SEQ ID NO: 34736 - DNA, 15 bp, Homo sapiens
agggtgaggttcctt

SEQ ID NO: 34737 - DNA, 15 bp, Homo sapiens
aagggtgaggttcct

SEQ ID NO: 34738 - DNA, 15 bp, Homo sapiens
aaagggtgaggttcc

SEQ ID NO: 34739 - DNA, 15 bp, Homo sapiens
gaaagggtgaggttc

SEQ ID NO: 34740 - DNA, 15 bp, Homo sapiens
tgaaagggtgaggtt

SEQ ID NO: 34741 - DNA, 15 bp, Homo sapiens
gtgaaagggtgaggt

SEQ ID NO: 34742 - DNA, 15 bp, Homo sapiens
tgtgaaagggtgagg

SEQ ID NO: 34743 - DNA, 15 bp, Homo sapiens
gtgtgaaagggtgag

SEQ ID NO: 34744 - DNA, 15 bp, Homo sapiens
tgtgtgaaagggtga

SEQ ID NO: 34745 - DNA, 15 bp, Homo sapiens
ctgtgtgaaagggtg

SEQ ID NO: 34746 - DNA, 15 bp, Homo sapiens
tctgtgtgaaagggt

SEQ ID NO: 34747 - DNA, 15 bp, Homo sapiens
gtctgtgtgaaaggg

SEQ ID NO: 34748 - DNA, 15 bp, Homo sapiens
tgtctgtgtgaaagg

SEQ ID NO: 34749 - DNA, 15 bp, Homo sapiens
ttgtctgtgtgaaag

SEQ ID NO: 34750 - DNA, 15 bp, Homo sapiens
tttgtctgtgtgaaa

SEQ ID NO: 34751 - DNA, 15 bp, Homo sapiens
atttgtctgtgtgaa

SEQ ID NO: 34752 - DNA, 15 bp, Homo sapiens
catttgtctgtgtga

SEQ ID NO: 34753 - DNA, 15 bp, Homo sapiens
ccatttgtctgtgtg

SEQ ID NO: 34754 - DNA, 15 bp, Homo sapiens
accatttgtctgtgt

SEQ ID NO: 34755 - DNA, 15 bp, Homo sapiens
taccatttgtctgtg

SEQ ID NO: 34756 - DNA, 15 bp, Homo sapiens
gtaccatttgtctgt

SEQ ID NO: 34757 - DNA, 15 bp, Homo sapiens
ggtaccatttgtctg

SEQ ID NO: 34758 - DNA, 15 bp, Homo sapiens
tggtaccatttgtct

SEQ ID NO: 34759 - DNA, 15 bp, Homo sapiens
atggtaccatttgtc

SEQ ID NO: 34760 - DNA, 15 bp, Homo sapiens
gatggtaccatttgt

SEQ ID NO: 34761 - DNA, 15 bp, Homo sapiens
ggatggtaccatttg

SEQ ID NO: 34762 - DNA, 15 bp, Homo sapiens
tggatggtaccattt

SEQ ID NO: 34763 - DNA, 15 bp, Homo sapiens
ctggatggtaccatt

SEQ ID NO: 34764 - DNA, 15 bp, Homo sapiens
actggatggtaccat

SEQ ID NO: 34765 - DNA, 15 bp, Homo sapiens
aactggatggtacca

SEQ ID NO: 34766 - DNA, 15 bp, Homo sapiens
taactggatggtacc

SEQ ID NO: 34767 - DNA, 15 bp, Homo sapiens
ttaactggatggtac

SEQ ID NO: 34768 - DNA, 15 bp, Homo sapiens
cttaactggatggta

SEQ ID NO: 34769 - DNA, 15 bp, Homo sapiens
gcttaactggatggt

SEQ ID NO: 34770 - DNA, 15 bp, Homo sapiens
ggcttaactggatgg

SEQ ID NO: 34771 - DNA, 15 bp, Homo sapiens
gggcttaactggatg

SEQ ID NO: 34772 - DNA, 15 bp, Homo sapiens
cgggcttaactggat

SEQ ID NO: 34773 - DNA, 15 bp, Homo sapiens
acgggcttaactgga

SEQ ID NO: 34774 - DNA, 15 bp, Homo sapiens
cacgggcttaactgg

SEQ ID NO: 34775 - DNA, 15 bp, Homo sapiens
tcacgggcttaactg

SEQ ID NO: 34776 - DNA, 15 bp, Homo sapiens
gtcacgggcttaact

SEQ ID NO: 34777 - DNA, 15 bp, Homo sapiens
tgtcacgggcttaac

SEQ ID NO: 34778 - DNA, 15 bp, Homo sapiens
ttgtcacgggcttaa

SEQ ID NO: 34779 - DNA, 15 bp, Homo sapiens
tttgtcacgggctta

SEQ ID NO: 34780 - DNA, 15 bp, Homo sapiens
ttttgtcacgggctt

SEQ ID NO: 34781 - DNA, 15 bp, Homo sapiens
tttttgtcacgggct

SEQ ID NO: 34782 - DNA, 15 bp, Homo sapiens
atttttgtcacgggc

SEQ ID NO: 34783 - DNA, 15 bp, Homo sapiens
catttttgtcacggg

SEQ ID NO: 34784 - DNA, 15 bp, Homo sapiens
ccatttttgtcacgg

SEQ ID NO: 34785 - DNA, 15 bp, Homo sapiens
tccatttttgtcacg

SEQ ID NO: 34786 - DNA, 15 bp, Homo sapiens
ttccatttttgtcac

SEQ ID NO: 34787 - DNA, 15 bp, Homo sapiens
tttccatttttgtca

SEQ ID NO: 34788 - DNA, 15 bp, Homo sapiens
atttccatttttgtc

SEQ ID NO: 34789 - DNA, 15 bp, Homo sapiens
aatttccatttttgt

SEQ ID NO: 34790 - DNA, 15 bp, Homo sapiens
aaatttccatttttg

SEQ ID NO: 34791 - DNA, 15 bp, Homo sapiens
gaaatttccattttt

SEQ ID NO: 34792 - DNA, 15 bp, Homo sapiens
agaaatttccatttt

SEQ ID NO: 34793 - DNA, 15 bp, Homo sapiens
tagaaatttccattt

SEQ ID NO: 34794 - DNA, 15 bp, Homo sapiens
ttagaaatttccatt

SEQ ID NO: 34795 - DNA, 15 bp, Homo sapiens
tttagaaatttccat

SEQ ID NO: 34796 - DNA, 15 bp, Homo sapiens
atttagaaatttcca

SEQ ID NO: 34797 - DNA, 15 bp, Homo sapiens
tatttagaaatttcc

SEQ ID NO: 34798 - DNA, 15 bp, Homo sapiens
ctatttagaaatttc

SEQ ID NO: 34799 - DNA, 15 bp, Homo sapiens
gctatttagaaattt

SEQ ID NO: 34800 - DNA, 15 bp, Homo sapiens
ggctatttagaaatt

SEQ ID NO: 34801 - DNA, 15 bp, Homo sapiens
gggctatttagaaat

SEQ ID NO: 34802 - DNA, 15 bp, Homo sapiens
tgggctatttagaaa

SEQ ID NO: 34803 - DNA, 15 bp, Homo sapiens
ttgggctatttagaa

SEQ ID NO: 34804 - DNA, 15 bp, Homo sapiens
cttgggctatttaga

SEQ ID NO: 34805 - DNA, 15 bp, Homo sapiens
acttgggctatttag

SEQ ID NO: 34806 - DNA, 15 bp, Homo sapiens
gacttgggctattta

SEQ ID NO: 34807 - DNA, 15 bp, Homo sapiens
agacttgggctattt

SEQ ID NO: 34808 - DNA, 15 bp, Homo sapiens
gagacttgggctatt

SEQ ID NO: 34809 - DNA, 15 bp, Homo sapiens
ggagacttgggctat

SEQ ID NO: 34810 - DNA, 15 bp, Homo sapiens
tggagacttgggcta

SEQ ID NO: 34811 - DNA, 15 bp, Homo sapiens
ctggagacttgggct

SEQ ID NO: 34812 - DNA, 15 bp, Homo sapiens
cctggagacttgggc

SEQ ID NO: 34813 - DNA, 15 bp, Homo sapiens
ccctggagacttggg

SEQ ID NO: 34814 - DNA, 15 bp, Homo sapiens
gccctggagacttgg

SEQ ID NO: 34815 - DNA, 15 bp, Homo sapiens
tgccctggagacttg

SEQ ID NO: 34816 - DNA, 15 bp, Homo sapiens
ttgccctggagactt

SEQ ID NO: 34817 - DNA, 15 bp, Homo sapiens
attgccctggagact

SEQ ID NO: 34818 - DNA, 15 bp, Homo sapiens
aattgccctggagac

SEQ ID NO: 34819 - DNA, 15 bp, Homo sapiens
caattgccctggaga

SEQ ID NO: 34820 - DNA, 15 bp, Homo sapiens
ccaattgccctggag

SEQ ID NO: 34821 - DNA, 15 bp, Homo sapiens
cccaattgccctgga

SEQ ID NO: 34822 - DNA, 15 bp, Homo sapiens
tcccaattgccctgg

SEQ ID NO: 34823 - DNA, 15 bp, Homo sapiens
ttcccaattgccctg

SEQ ID NO: 34824 - DNA, 15 bp, Homo sapiens
gttcccaattgccct

SEQ ID NO: 34825 - DNA, 15 bp, Homo sapiens
tgttcccaattgccc

SEQ ID NO: 34826 - DNA, 15 bp, Homo sapiens
ctgttcccaattgcc

SEQ ID NO: 34827 - DNA, 15 bp, Homo sapiens
gctgttcccaattgc

SEQ ID NO: 34828 - DNA, 15 bp, Homo sapiens
agctgttcccaattg

SEQ ID NO: 34829 - DNA, 15 bp, Homo sapiens
aagctgttcccaatt

SEQ ID NO: 34830 - DNA, 15 bp, Homo sapiens
aaagctgttcccaat

SEQ ID NO: 34831 - DNA, 15 bp, Homo sapiens
caaagctgttcccaa

SEQ ID NO: 34832 - DNA, 15 bp, Homo sapiens
tcaaagctgttccca

SEQ ID NO: 34833 - DNA, 15 bp, Homo sapiens
ttcaaagctgttccc

SEQ ID NO: 34834 - DNA, 15 bp, Homo sapiens
gttcaaagctgttcc

SEQ ID NO: 34835 - DNA, 15 bp, Homo sapiens
ggttcaaagctgttc

SEQ ID NO: 34836 - DNA, 15 bp, Homo sapiens
gggttcaaagctgtt

SEQ ID NO: 34837 - DNA, 15 bp, Homo sapiens
tgggttcaaagctgt

SEQ ID NO: 34838 - DNA, 15 bp, Homo sapiens
gtgggttcaaagctg

SEQ ID NO: 34839 - DNA, 15 bp, Homo sapiens
agtgggttcaaagct

SEQ ID NO: 34840 - DNA, 15 bp, Homo sapiens
tagtgggttcaaagc

SEQ ID NO: 34841 - DNA, 15 bp, Homo sapiens
ttagtgggttcaaag

SEQ ID NO: 34842 - DNA, 15 bp, Homo sapiens
cttagtgggttcaaa

SEQ ID NO: 34843 - DNA, 15 bp, Homo sapiens
tcttagtgggttcaa

SEQ ID NO: 34844 - DNA, 15 bp, Homo sapiens
atcttagtgggttca

SEQ ID NO: 34845 - DNA, 15 bp, Homo sapiens
catcttagtgggttc

SEQ ID NO: 34846 - DNA, 15 bp, Homo sapiens
ccatcttagtgggtt

SEQ ID NO: 34847 - DNA, 15 bp, Homo sapiens
cccatcttagtgggt

SEQ ID NO: 34848 - DNA, 15 bp, Homo sapiens
ccccatcttagtggg

SEQ ID NO: 34849 - DNA, 15 bp, Homo sapiens
accccatcttagtgg

SEQ ID NO: 34850 - DNA, 15 bp, Homo sapiens
gaccccatcttagtg

SEQ ID NO: 34851 - DNA, 15 bp, Homo sapiens
agaccccatcttagt

SEQ ID NO: 34852 - DNA, 15 bp, Homo sapiens
cagaccccatcttag

SEQ ID NO: 34853 - DNA, 15 bp, Homo sapiens
gcagaccccatctta

SEQ ID NO: 34854 - DNA, 15 bp, Homo sapiens
agcagaccccatctt

SEQ ID NO: 34855 - DNA, 15 bp, Homo sapiens
tagcagaccccatct

SEQ ID NO: 34856 - DNA, 15 bp, Homo sapiens
atagcagaccccatc

SEQ ID NO: 34857 - DNA, 15 bp, Homo sapiens
catagcagaccccat

SEQ ID NO: 34858 - DNA, 15 bp, Homo sapiens
gcatagcagacccca

SEQ ID NO: 34859 - DNA, 15 bp, Homo sapiens
ggcatagcagacccc

SEQ ID NO: 34860 - DNA, 15 bp, Homo sapiens
tggcatagcagaccc

SEQ ID NO: 34861 - DNA, 15 bp, Homo sapiens
ttggcatagcagacc

SEQ ID NO: 34862 - DNA, 15 bp, Homo sapiens
tttggcatagcagac

SEQ ID NO: 34863 - DNA, 15 bp, Homo sapiens
ttttggcatagcaga

SEQ ID NO: 34864 - DNA, 15 bp, Homo sapiens
gttttggcatagcag

SEQ ID NO: 34865 - DNA, 15 bp, Homo sapiens
tgttttggcatagca

SEQ ID NO: 34866 - DNA, 15 bp, Homo sapiens
atgttttggcatagc

SEQ ID NO: 34867 - DNA, 15 bp, Homo sapiens
tatgttttggcatag

SEQ ID NO: 34868 - DNA, 15 bp, Homo sapiens
ctatgttttggcata

SEQ ID NO: 34869 - DNA, 15 bp, Homo sapiens
tctatgttttggcat

SEQ ID NO: 34870 - DNA, 15 bp, Homo sapiens
atctatgttttggca

SEQ ID NO: 34871 - DNA, 15 bp, Homo sapiens
tatctatgttttggc

SEQ ID NO: 34872 - DNA, 15 bp, Homo sapiens
gtatctatgttttgg

SEQ ID NO: 34873 - DNA, 15 bp, Homo sapiens
tgtatctatgttttg

SEQ ID NO: 34874 - DNA, 15 bp, Homo sapiens
ctgtatctatgtttt

SEQ ID NO: 34875 - DNA, 15 bp, Homo sapiens
tctgtatctatgttt

SEQ ID NO: 34876 - DNA, 15 bp, Homo sapiens
ttctgtatctatgtt

SEQ ID NO: 34877 - DNA, 15 bp, Homo sapiens
attctgtatctatgt

SEQ ID NO: 34878 - DNA, 15 bp, Homo sapiens
aattctgtatctatg

SEQ ID NO: 34879 - DNA, 15 bp, Homo sapiens
gaattctgtatctat

SEQ ID NO: 34880 - DNA, 15 bp, Homo sapiens
tgaattctgtatcta

SEQ ID NO: 34881 - DNA, 15 bp, Homo sapiens
gtgaattctgtatct

SEQ ID NO: 34882 - DNA, 15 bp, Homo sapiens
tgtgaattctgtatc

SEQ ID NO: 34883 - DNA, 15 bp, Homo sapiens
ctgtgaattctgtat

SEQ ID NO: 34884 - DNA, 15 bp, Homo sapiens
actgtgaattctgta

SEQ ID NO: 34885 - DNA, 15 bp, Homo sapiens
aactgtgaattctgt

SEQ ID NO: 34886 - DNA, 15 bp, Homo sapiens
aaactgtgaattctg

SEQ ID NO: 34887 - DNA, 15 bp, Homo sapiens
caaactgtgaattct

SEQ ID NO: 34888 - DNA, 15 bp, Homo sapiens
acaaactgtgaattc

SEQ ID NO: 34889 - DNA, 15 bp, Homo sapiens
gacaaactgtgaatt

SEQ ID NO: 34890 - DNA, 15 bp, Homo sapiens
ggacaaactgtgaat

SEQ ID NO: 34891 - DNA, 15 bp, Homo sapiens
aggacaaactgtgaa

SEQ ID NO: 34892 - DNA, 15 bp, Homo sapiens
caggacaaactgtga

SEQ ID NO: 34893 - DNA, 15 bp, Homo sapiens
gcaggacaaactgtg

SEQ ID NO: 34894 - DNA, 15 bp, Homo sapiens
tgcaggacaaactgt

SEQ ID NO: 34895 - DNA, 15 bp, Homo sapiens
atgcaggacaaactg

SEQ ID NO: 34896 - DNA, 15 bp, Homo sapiens
aatgcaggacaaact

SEQ ID NO: 34897 - DNA, 15 bp, Homo sapiens
taatgcaggacaaac

SEQ ID NO: 34898 - DNA, 15 bp, Homo sapiens
ctaatgcaggacaaa

SEQ ID NO: 34899 - DNA, 15 bp, Homo sapiens
cctaatgcaggacaa

SEQ ID NO: 34900 - DNA, 15 bp, Homo sapiens
tcctaatgcaggaca

SEQ ID NO: 34901 - DNA, 15 bp, Homo sapiens
gtcctaatgcaggac

SEQ ID NO: 34902 - DNA, 15 bp, Homo sapiens
tgtcctaatgcagga

SEQ ID NO: 34903 - DNA, 15 bp, Homo sapiens
atgtcctaatgcagg

SEQ ID NO: 34904 - DNA, 15 bp, Homo sapiens
aatgtcctaatgcag

SEQ ID NO: 34905 - DNA, 15 bp, Homo sapiens
gaatgtcctaatgca

SEQ ID NO: 34906 - DNA, 15 bp, Homo sapiens
agaatgtcctaatgc

SEQ ID NO: 34907 - DNA, 15 bp, Homo sapiens
gagaatgtcctaatg

SEQ ID NO: 34908 - DNA, 15 bp, Homo sapiens
agagaatgtcctaat

SEQ ID NO: 34909 - DNA, 15 bp, Homo sapiens
aagagaatgtcctaa

SEQ ID NO: 34910 - DNA, 15 bp, Homo sapiens
gaagagaatgtccta

SEQ ID NO: 34911 - DNA, 15 bp, Homo sapiens
tgaagagaatgtcct

SEQ ID NO: 34912 - DNA, 15 bp, Homo sapiens
ttgaagagaatgtcc

SEQ ID NO: 34913 - DNA, 15 bp, Homo sapiens
gttgaagagaatgtc

SEQ ID NO: 34914 - DNA, 15 bp, Homo sapiens
agttgaagagaatgt

SEQ ID NO: 34915 - DNA, 15 bp, Homo sapiens
aagttgaagagaatg

SEQ ID NO: 34916 - DNA, 15 bp, Homo sapiens
aaagttgaagagaat

SEQ ID NO: 34917 - DNA, 15 bp, Homo sapiens
caaagttgaagagaa

SEQ ID NO: 34918 - DNA, 15 bp, Homo sapiens
gcaaagttgaagaga

SEQ ID NO: 34919 - DNA, 15 bp, Homo sapiens
ggcaaagttgaagag

SEQ ID NO: 34920 - DNA, 15 bp, Homo sapiens
tggcaaagttgaaga

SEQ ID NO: 34921 - DNA, 15 bp, Homo sapiens
gtggcaaagttgaag

SEQ ID NO: 34922 - DNA, 15 bp, Homo sapiens
agtggcaaagttgaa

SEQ ID NO: 34923 - DNA, 15 bp, Homo sapiens
cagtggcaaagttga

SEQ ID NO: 34924 - DNA, 15 bp, Homo sapiens
acagtggcaaagttg

SEQ ID NO: 34925 - DNA, 15 bp, Homo sapiens
tacagtggcaaagtt

SEQ ID NO: 34926 - DNA, 15 bp, Homo sapiens
ctacagtggcaaagt

SEQ ID NO: 34927 - DNA, 15 bp, Homo sapiens
tctacagtggcaaag

SEQ ID NO: 34928 - DNA, 15 bp, Homo sapiens
ttctacagtggcaaa

SEQ ID NO: 34929 - DNA, 15 bp, Homo sapiens
tttctacagtggcaa

SEQ ID NO: 34930 - DNA, 15 bp, Homo sapiens
ctttctacagtggca

SEQ ID NO: 34931 - DNA, 15 bp, Homo sapiens
actttctacagtggc

SEQ ID NO: 34932 - DNA, 15 bp, Homo sapiens
cactttctacagtgg

SEQ ID NO: 34933 - DNA, 15 bp, Homo sapiens
ccactttctacagtg

SEQ ID NO: 34934 - DNA, 15 bp, Homo sapiens
tccactttctacagt

SEQ ID NO: 34935 - DNA, 15 bp, Homo sapiens
ctccactttctacag

SEQ ID NO: 34936 - DNA, 15 bp, Homo sapiens
cctccactttctaca

SEQ ID NO: 34937 - DNA, 15 bp, Homo sapiens
acctccactttctac

SEQ ID NO: 34938 - DNA, 15 bp, Homo sapiens
tacctccactttcta

SEQ ID NO: 34939 - DNA, 15 bp, Homo sapiens
ctacctccactttct

SEQ ID NO: 34940 - DNA, 15 bp, Homo sapiens
cctacctccactttc

SEQ ID NO: 34941 - DNA, 15 bp, Homo sapiens
acctacctccacttt

SEQ ID NO: 34942 - DNA, 15 bp, Homo sapiens
gacctacctccactt

SEQ ID NO: 34943 - DNA, 15 bp, Homo sapiens
tgacctacctccact

SEQ ID NO: 34944 - DNA, 15 bp, Homo sapiens
ctgacctacctccac

SEQ ID NO: 34945 - DNA, 15 bp, Homo sapiens
gctgacctacctcca

SEQ ID NO: 34946 - DNA, 15 bp, Homo sapiens
cgctgacctacctcc

SEQ ID NO: 34947 - DNA, 15 bp, Homo sapiens
ccgctgacctacctc

SEQ ID NO: 34948 - DNA, 15 bp, Homo sapiens
tccgctgacctacct

SEQ ID NO: 34949 - DNA, 15 bp, Homo sapiens
atccgctgacctacc

SEQ ID NO: 34950 - DNA, 15 bp, Homo sapiens
catccgctgacctac

SEQ ID NO: 34951 - DNA, 15 bp, Homo sapiens
ccatccgctgaccta

SEQ ID NO: 34952 - DNA, 15 bp, Homo sapiens
accatccgctgacct

SEQ ID NO: 34953 - DNA, 15 bp, Homo sapiens
caccatccgctgacc

SEQ ID NO: 34954 - DNA, 15 bp, Homo sapiens
gcaccatccgctgac

SEQ ID NO: 34955 - DNA, 15 bp, Homo sapiens
ggcaccatccgctga

SEQ ID NO: 34956 - DNA, 15 bp, Homo sapiens
tggcaccatccgctg

SEQ ID NO: 34957 - DNA, 15 bp, Homo sapiens
gtggcaccatccgct

SEQ ID NO: 34958 - DNA, 15 bp, Homo sapiens
tgtggcaccatccgc

SEQ ID NO: 34959 - DNA, 15 bp, Homo sapiens
atgtggcaccatccg

SEQ ID NO: 34960 - DNA, 15 bp, Homo sapiens
aatgtggcaccatcc

SEQ ID NO: 34961 - DNA, 15 bp, Homo sapiens
taatgtggcaccatc

SEQ ID NO: 34962 - DNA, 15 bp, Homo sapiens
ttaatgtggcaccat

SEQ ID NO: 34963 - DNA, 15 bp, Homo sapiens
gttaatgtggcacca

SEQ ID NO: 34964 - DNA, 15 bp, Homo sapiens
tgttaatgtggcacc

SEQ ID NO: 34965 - DNA, 15 bp, Homo sapiens
ctgttaatgtggcac

SEQ ID NO: 34966 - DNA, 15 bp, Homo sapiens
gctgttaatgtggca

SEQ ID NO: 34967 - DNA, 15 bp, Homo sapiens
ggctgttaatgtggc

SEQ ID NO: 34968 - DNA, 15 bp, Homo sapiens
cggctgttaatgtgg

SEQ ID NO: 34969 - DNA, 15 bp, Homo sapiens
gcggctgttaatgtg

SEQ ID NO: 34970 - DNA, 15 bp, Homo sapiens
ggcggctgttaatgt

SEQ ID NO: 34971 - DNA, 15 bp, Homo sapiens
aggcggctgttaatg

SEQ ID NO: 34972 - DNA, 15 bp, Homo sapiens
aaggcggctgttaat

SEQ ID NO: 34973 - DNA, 15 bp, Homo sapiens
taaggcggctgttaa

SEQ ID NO: 34974 - DNA, 15 bp, Homo sapiens
gtaaggcggctgtta

SEQ ID NO: 34975 - DNA, 15 bp, Homo sapiens
agtaaggcggctgtt

SEQ ID NO: 34976 - DNA, 15 bp, Homo sapiens
cagtaaggcggctgt

SEQ ID NO: 34977 - DNA, 15 bp, Homo sapiens
tcagtaaggcggctg

SEQ ID NO: 34978 - DNA, 15 bp, Homo sapiens
ttcagtaaggcggct

SEQ ID NO: 34979 - DNA, 15 bp, Homo sapiens
cttcagtaaggcggc

SEQ ID NO: 34980 - DNA, 15 bp, Homo sapiens
acttcagtaaggcgg

SEQ ID NO: 34981 - DNA, 15 bp, Homo sapiens
cacttcagtaaggcg

SEQ ID NO: 34982 - DNA, 15 bp, Homo sapiens
acacttcagtaaggc

SEQ ID NO: 34983 - DNA, 15 bp, Homo sapiens
tacacttcagtaagg

SEQ ID NO: 34984 - DNA, 15 bp, Homo sapiens
ctacacttcagtaag

SEQ ID NO: 34985 - DNA, 15 bp, Homo sapiens
actacacttcagtaa

SEQ ID NO: 34986 - DNA, 15 bp, Homo sapiens
gactacacttcagta

SEQ ID NO: 34987 - DNA, 15 bp, Homo sapiens
ggactacacttcagt

SEQ ID NO: 34988 - DNA, 15 bp, Homo sapiens
tggactacacttcag

SEQ ID NO: 34989 - DNA, 15 bp, Homo sapiens
ttggactacacttca

SEQ ID NO: 34990 - DNA, 15 bp, Homo sapiens
gttggactacacttc

SEQ ID NO: 34991 - DNA, 15 bp, Homo sapiens
tgttggactacactt

SEQ ID NO: 34992 - DNA, 15 bp, Homo sapiens
ctgttggactacact

SEQ ID NO: 34993 - DNA, 15 bp, Homo sapiens
cctgttggactacac

SEQ ID NO: 34994 - DNA, 15 bp, Homo sapiens
ccctgttggactaca

SEQ ID NO: 34995 - DNA, 15 bp, Homo sapiens
accctgttggactac

SEQ ID NO: 34996 - DNA, 15 bp, Homo sapiens
gaccctgttggacta

SEQ ID NO: 34997 - DNA, 15 bp, Homo sapiens
agaccctgttggact

SEQ ID NO: 34998 - DNA, 15 bp, Homo sapiens
aagaccctgttggac

SEQ ID NO: 34999 - DNA, 15 bp, Homo sapiens
taagaccctgttgga

SEQ ID NO: 35000 - DNA, 15 bp, Homo sapiens
gtaagaccctgttgg

SEQ ID NO: 35001 - DNA, 15 bp, Homo sapiens
agtaagaccctgttg

SEQ ID NO: 35002 - DNA, 15 bp, Homo sapiens
cagtaagaccctgtt

SEQ ID NO: 35003 - DNA, 15 bp, Homo sapiens
gcagtaagaccctgt

SEQ ID NO: 35004 - DNA, 15 bp, Homo sapiens
ggcagtaagaccctg

SEQ ID NO: 35005 - DNA, 15 bp, Homo sapiens
tggcagtaagaccct

SEQ ID NO: 35006 - DNA, 15 bp, Homo sapiens
gtggcagtaagaccc

SEQ ID NO: 35007 - DNA, 15 bp, Homo sapiens
agtggcagtaagacc

SEQ ID NO: 35008 - DNA, 15 bp, Homo sapiens
cagtggcagtaagac

SEQ ID NO: 35009 - DNA, 15 bp, Homo sapiens
acagtggcagtaaga

SEQ ID NO: 35010 - DNA, 15 bp, Homo sapiens
cacagtggcagtaag

SEQ ID NO: 35011 - DNA, 15 bp, Homo sapiens
tcacagtggcagtaa

SEQ ID NO: 35012 - DNA, 15 bp, Homo sapiens
gtcacagtggcagta

SEQ ID NO: 35013 - DNA, 15 bp, Homo sapiens
tgtcacagtggcagt

SEQ ID NO: 35014 - DNA, 15 bp, Homo sapiens
gtgtcacagtggcag

SEQ ID NO: 35015 - DNA, 15 bp, Homo sapiens
cgtgtcacagtggca

SEQ ID NO: 35016 - DNA, 15 bp, Homo sapiens
acgtgtcacagtggc

SEQ ID NO: 35017 - DNA, 15 bp, Homo sapiens
cacgtgtcacagtgg

SEQ ID NO: 35018 - DNA, 15 bp, Homo sapiens
gcacgtgtcacagtg

SEQ ID NO: 35019 - DNA, 15 bp, Homo sapiens
ggcacgtgtcacagt

SEQ ID NO: 35020 - DNA, 15 bp, Homo sapiens
aggcacgtgtcacag

SEQ ID NO: 35021 - DNA, 15 bp, Homo sapiens
aaggcacgtgtcaca

SEQ ID NO: 35022 - DNA, 15 bp, Homo sapiens
caaggcacgtgtcac

SEQ ID NO: 35023 - DNA, 15 bp, Homo sapiens
gcaaggcacgtgtca

SEQ ID NO: 35024 - DNA, 15 bp, Homo sapiens
ggcaaggcacgtgtc

SEQ ID NO: 35025 - DNA, 15 bp, Homo sapiens
aggcaaggcacgtgt

SEQ ID NO: 35026 - DNA, 15 bp, Homo sapiens
aaggcaaggcacgtg

SEQ ID NO: 35027 - DNA, 15 bp, Homo sapiens
caaggcaaggcacgt

SEQ ID NO: 35028 - DNA, 15 bp, Homo sapiens
ccaaggcaaggcacg

SEQ ID NO: 35029 - DNA, 15 bp, Homo sapiens
cccaaggcaaggcac

SEQ ID NO: 35030 - DNA, 15 bp, Homo sapiens
ccccaaggcaaggca

SEQ ID NO: 35031 - DNA, 15 bp, Homo sapiens
cccccaaggcaaggc

SEQ ID NO: 35032 - DNA, 15 bp, Homo sapiens
acccccaaggcaagg

SEQ ID NO: 35033 - DNA, 15 bp, Homo sapiens
cacccccaaggcaag

SEQ ID NO: 35034 - DNA, 15 bp, Homo sapiens
gcacccccaaggcaa

SEQ ID NO: 35035 - DNA, 15 bp, Homo sapiens
cgcacccccaaggca

SEQ ID NO: 35036 - DNA, 15 bp, Homo sapiens
acgcacccccaaggc

SEQ ID NO: 35037 - DNA, 15 bp, Homo sapiens
aacgcacccccaagg

SEQ ID NO: 35038 - DNA, 15 bp, Homo sapiens
aaacgcacccccaag

SEQ ID NO: 35039 - DNA, 15 bp, Homo sapiens
gaaacgcacccccaa

SEQ ID NO: 35040 - DNA, 15 bp, Homo sapiens
ggaaacgcaccccca

SEQ ID NO: 35041 - DNA, 15 bp, Homo sapiens
gggaaacgcaccccc

SEQ ID NO: 35042 - DNA, 15 bp, Homo sapiens
ggggaaacgcacccc

SEQ ID NO: 35043 - DNA, 15 bp, Homo sapiens
tggggaaacgcaccc

SEQ ID NO: 35044 - DNA, 15 bp, Homo sapiens
gtggggaaacgcacc

SEQ ID NO: 35045 - DNA, 15 bp, Homo sapiens
ggtggggaaacgcac

SEQ ID NO: 35046 - DNA, 15 bp, Homo sapiens
aggtggggaaacgca

SEQ ID NO: 35047 - DNA, 15 bp, Homo sapiens
gaggtggggaaacgc

SEQ ID NO: 35048 - DNA, 15 bp, Homo sapiens
agaggtggggaaacg

SEQ ID NO: 35049 - DNA, 15 bp, Homo sapiens
gagaggtggggaaac

SEQ ID NO: 35050 - DNA, 15 bp, Homo sapiens
ggagaggtggggaaa

SEQ ID NO: 35051 - DNA, 15 bp, Homo sapiens
aggagaggtggggaa

SEQ ID NO: 35052 - DNA, 15 bp, Homo sapiens
aaggagaggtgggga

SEQ ID NO: 35053 - DNA, 15 bp, Homo sapiens
caaggagaggtgggg

SEQ ID NO: 35054 - DNA, 15 bp, Homo sapiens
gcaaggagaggtggg

SEQ ID NO: 35055 - DNA, 15 bp, Homo sapiens
agcaaggagaggtgg

SEQ ID NO: 35056 - DNA, 15 bp, Homo sapiens
gagcaaggagaggtg

SEQ ID NO: 35057 - DNA, 15 bp, Homo sapiens
agagcaaggagaggt

SEQ ID NO: 35058 - DNA, 15 bp, Homo sapiens
cagagcaaggagagg

SEQ ID NO: 35059 - DNA, 15 bp, Homo sapiens
gcagagcaaggagag

SEQ ID NO: 35060 - DNA, 15 bp, Homo sapiens
tgcagagcaaggaga

SEQ ID NO: 35061 - DNA, 15 bp, Homo sapiens
ctgcagagcaaggag

SEQ ID NO: 35062 - DNA, 15 bp, Homo sapiens
gctgcagagcaagga

SEQ ID NO: 35063 - DNA, 15 bp, Homo sapiens
agctgcagagcaagg

SEQ ID NO: 35064 - DNA, 15 bp, Homo sapiens
aagctgcagagcaag

SEQ ID NO: 35065 - DNA, 15 bp, Homo sapiens
caagctgcagagcaa

SEQ ID NO: 35066 - DNA, 15 bp, Homo sapiens
acaagctgcagagca

SEQ ID NO: 35067 - DNA, 15 bp, Homo sapiens
gacaagctgcagagc

SEQ ID NO: 35068 - DNA, 15 bp, Homo sapiens
ggacaagctgcagag

SEQ ID NO: 35069 - DNA, 15 bp, Homo sapiens
cggacaagctgcaga

SEQ ID NO: 35070 - DNA, 15 bp, Homo sapiens
tcggacaagctgcag

SEQ ID NO: 35071 - DNA, 15 bp, Homo sapiens
ttcggacaagctgca

SEQ ID NO: 35072 - DNA, 15 bp, Homo sapiens
tttcggacaagctgc

SEQ ID NO: 35073 - DNA, 15 bp, Homo sapiens
ttttcggacaagctg

SEQ ID NO: 35074 - DNA, 15 bp, Homo sapiens
gttttcggacaagct

SEQ ID NO: 35075 - DNA, 15 bp, Homo sapiens
ggttttcggacaagc

SEQ ID NO: 35076 - DNA, 15 bp, Homo sapiens
tggttttcggacaag

SEQ ID NO: 35077 - DNA, 15 bp, Homo sapiens
ctggttttcggacaa

SEQ ID NO: 35078 - DNA, 15 bp, Homo sapiens
actggttttcggaca

SEQ ID NO: 35079 - DNA, 15 bp, Homo sapiens
gactggttttcggac

SEQ ID NO: 35080 - DNA, 15 bp, Homo sapiens
ggactggttttcgga

SEQ ID NO: 35081 - DNA, 15 bp, Homo sapiens
aggactggttttcgg

SEQ ID NO: 35082 - DNA, 15 bp, Homo sapiens
aaggactggttttcg

SEQ ID NO: 35083 - DNA, 15 bp, Homo sapiens
caaggactggttttc

SEQ ID NO: 35084 - DNA, 15 bp, Homo sapiens
gcaaggactggtttt

SEQ ID NO: 35085 - DNA, 15 bp, Homo sapiens
agcaaggactggttt

SEQ ID NO: 35086 - DNA, 15 bp, Homo sapiens
cagcaaggactggtt

SEQ ID NO: 35087 - DNA, 15 bp, Homo sapiens
tcagcaaggactggt

SEQ ID NO: 35088 - DNA, 15 bp, Homo sapiens
ctcagcaaggactgg

SEQ ID NO: 35089 - DNA, 15 bp, Homo sapiens
cctcagcaaggactg

SEQ ID NO: 35090 - DNA, 15 bp, Homo sapiens
tcctcagcaaggact

SEQ ID NO: 35091 - DNA, 15 bp, Homo sapiens
atcctcagcaaggac

SEQ ID NO: 35092 - DNA, 15 bp, Homo sapiens
catcctcagcaagga

SEQ ID NO: 35093 - DNA, 15 bp, Homo sapiens
gcatcctcagcaagg

SEQ ID NO: 35094 - DNA, 15 bp, Homo sapiens
ggcatcctcagcaag

SEQ ID NO: 35095 - DNA, 15 bp, Homo sapiens
gggcatcctcagcaa

SEQ ID NO: 35096 - DNA, 15 bp, Homo sapiens
ggggcatcctcagca

SEQ ID NO: 35097 - DNA, 15 bp, Homo sapiens
gggggcatcctcagc

SEQ ID NO: 35098 - DNA, 15 bp, Homo sapiens
ggggggcatcctcag

SEQ ID NO: 35099 - DNA, 15 bp, Homo sapiens
aggggggcatcctca

SEQ ID NO: 35100 - DNA, 15 bp, Homo sapiens
caggggggcatcctc

SEQ ID NO: 35101 - DNA, 15 bp, Homo sapiens
ccaggggggcatcct

SEQ ID NO: 35102 - DNA, 15 bp, Homo sapiens
cccaggggggcatcc

SEQ ID NO: 35103 - DNA, 15 bp, Homo sapiens
tcccaggggggcatc

SEQ ID NO: 35104 - DNA, 15 bp, Homo sapiens
ctcccaggggggcat

SEQ ID NO: 35105 - DNA, 15 bp, Homo sapiens
tctcccaggggggca

SEQ ID NO: 35106 - DNA, 15 bp, Homo sapiens
ttctcccaggggggc

SEQ ID NO: 35107 - DNA, 15 bp, Homo sapiens
gttctcccagggggg

SEQ ID NO: 35108 - DNA, 15 bp, Homo sapiens
tgttctcccaggggg

SEQ ID NO: 35109 - DNA, 15 bp, Homo sapiens
atgttctcccagggg

SEQ ID NO: 35110 - DNA, 15 bp, Homo sapiens
gatgttctcccaggg

SEQ ID NO: 35111 - DNA, 15 bp, Homo sapiens
agatgttctcccagg

SEQ ID NO: 35112 - DNA, 15 bp, Homo sapiens
cagatgttctcccag

SEQ ID NO: 35113 - DNA, 15 bp, Homo sapiens
ccagatgttctccca

SEQ ID NO: 35114 - DNA, 15 bp, Homo sapiens
gccagatgttctccc

SEQ ID NO: 35115 - DNA, 15 bp, Homo sapiens
agccagatgttctcc

SEQ ID NO: 35116 - DNA, 15 bp, Homo sapiens
gagccagatgttctc

SEQ ID NO: 35117 - DNA, 15 bp, Homo sapiens
cgagccagatgttct

SEQ ID NO: 35118 - DNA, 15 bp, Homo sapiens
acgagccagatgttc

SEQ ID NO: 35119 - DNA, 15 bp, Homo sapiens
cacgagccagatgtt

SEQ ID NO: 35120 - DNA, 15 bp, Homo sapiens
ccacgagccagatgt

SEQ ID NO: 35121 - DNA, 15 bp, Homo sapiens
cccacgagccagatg

SEQ ID NO: 35122 - DNA, 15 bp, Homo sapiens
gcccacgagccagat

SEQ ID NO: 35123 - DNA, 15 bp, Homo sapiens
agcccacgagccaga

SEQ ID NO: 35124 - DNA, 15 bp, Homo sapiens
gagcccacgagccag

SEQ ID NO: 35125 - DNA, 15 bp, Homo sapiens
ggagcccacgagcca

SEQ ID NO: 35126 - DNA, 15 bp, Homo sapiens
tggagcccacgagcc

SEQ ID NO: 35127 - DNA, 15 bp, Homo sapiens
atggagcccacgagc

SEQ ID NO: 35128 - DNA, 15 bp, Homo sapiens
gatggagcccacgag

SEQ ID NO: 35129 - DNA, 15 bp, Homo sapiens
agatggagcccacga

SEQ ID NO: 35130 - DNA, 15 bp, Homo sapiens
cagatggagcccacg

SEQ ID NO: 35131 - DNA, 15 bp, Homo sapiens
gcagatggagcccac

SEQ ID NO: 35132 - DNA, 15 bp, Homo sapiens
ggcagatggagccca

SEQ ID NO: 35133 - DNA, 15 bp, Homo sapiens
aggcagatggagccc

SEQ ID NO: 35134 - DNA, 15 bp, Homo sapiens
caggcagatggagcc

SEQ ID NO: 35135 - DNA, 15 bp, Homo sapiens
acaggcagatggagc

SEQ ID NO: 35136 - DNA, 15 bp, Homo sapiens
gacaggcagatggag

SEQ ID NO: 35137 - DNA, 15 bp, Homo sapiens
ggacaggcagatgga

SEQ ID NO: 35138 - DNA, 15 bp, Homo sapiens
tggacaggcagatgg

SEQ ID NO: 35139 - DNA, 15 bp, Homo sapiens
atggacaggcagatg

SEQ ID NO: 35140 - DNA, 15 bp, Homo sapiens
catggacaggcagat

SEQ ID NO: 35141 - DNA, 15 bp, Homo sapiens
acatggacaggcaga

SEQ ID NO: 35142 - DNA, 15 bp, Homo sapiens
gacatggacaggcag

SEQ ID NO: 35143 - DNA, 15 bp, Homo sapiens
tgacatggacaggca

SEQ ID NO: 35144 - DNA, 15 bp, Homo sapiens
gtgacatggacaggc

SEQ ID NO: 35145 - DNA, 15 bp, Homo sapiens
agtgacatggacagg

SEQ ID NO: 35146 - DNA, 15 bp, Homo sapiens
gagtgacatggacag

SEQ ID NO: 35147 - DNA, 15 bp, Homo sapiens
ggagtgacatggaca

SEQ ID NO: 35148 - DNA, 15 bp, Homo sapiens
tggagtgacatggac

SEQ ID NO: 35149 - DNA, 15 bp, Homo sapiens
gtggagtgacatgga

SEQ ID NO: 35150 - DNA, 15 bp, Homo sapiens
agtggagtgacatgg

SEQ ID NO: 35151 - DNA, 15 bp, Homo sapiens
aagtggagtgacatg

SEQ ID NO: 35152 - DNA, 15 bp, Homo sapiens
gaagtggagtgacat

SEQ ID NO: 35153 - DNA, 15 bp, Homo sapiens
ggaagtggagtgaca

SEQ ID NO: 35154 - DNA, 15 bp, Homo sapiens
aggaagtggagtgac

SEQ ID NO: 35155 - DNA, 15 bp, Homo sapiens
caggaagtggagtga

SEQ ID NO: 35156 - DNA, 15 bp, Homo sapiens
tcaggaagtggagtg

SEQ ID NO: 35157 - DNA, 15 bp, Homo sapiens
atcaggaagtggagt

SEQ ID NO: 35158 - DNA, 15 bp, Homo sapiens
gatcaggaagtggag

SEQ ID NO: 35159 - DNA, 15 bp, Homo sapiens
ggatcaggaagtgga

SEQ ID NO: 35160 - DNA, 15 bp, Homo sapiens
aggatcaggaagtgg

SEQ ID NO: 35161 - DNA, 15 bp, Homo sapiens
gaggatcaggaagtg

SEQ ID NO: 35162 - DNA, 15 bp, Homo sapiens
agaggatcaggaagt

SEQ ID NO: 35163 - DNA, 15 bp, Homo sapiens
tagaggatcaggaag

SEQ ID NO: 35164 - DNA, 15 bp, Homo sapiens
atagaggatcaggaa

SEQ ID NO: 35165 - DNA, 15 bp, Homo sapiens
catagaggatcagga

SEQ ID NO: 35166 - DNA, 15 bp, Homo sapiens
acatagaggatcagg

SEQ ID NO: 35167 - DNA, 15 bp, Homo sapiens
gacatagaggatcag

SEQ ID NO: 35168 - DNA, 15 bp, Homo sapiens
cgacatagaggatca

SEQ ID NO: 35169 - DNA, 15 bp, Homo sapiens
tcgacatagaggatc

SEQ ID NO: 35170 - DNA, 15 bp, Homo sapiens
ttcgacatagaggat

SEQ ID NO: 35171 - DNA, 15 bp, Homo sapiens
gttcgacatagagga

SEQ ID NO: 35172 - DNA, 15 bp, Homo sapiens
ggttcgacatagagg

SEQ ID NO: 35173 - DNA, 15 bp, Homo sapiens
gggttcgacatagag

SEQ ID NO: 35174 - DNA, 15 bp, Homo sapiens
agggttcgacataga

SEQ ID NO: 35175 - DNA, 15 bp, Homo sapiens
aagggttcgacatag

SEQ ID NO: 35176 - DNA, 15 bp, Homo sapiens
caagggttcgacata

SEQ ID NO: 35177 - DNA, 15 bp, Homo sapiens
gcaagggttcgacat

SEQ ID NO: 35178 - DNA, 15 bp, Homo sapiens
ggcaagggttcgaca

SEQ ID NO: 35179 - DNA, 15 bp, Homo sapiens
tggcaagggttcgac

SEQ ID NO: 35180 - DNA, 15 bp, Homo sapiens
ctggcaagggttcga

SEQ ID NO: 35181 - DNA, 15 bp, Homo sapiens
actggcaagggttcg

SEQ ID NO: 35182 - DNA, 15 bp, Homo sapiens
tactggcaagggttc

SEQ ID NO: 35183 - DNA, 15 bp, Homo sapiens
ttactggcaagggtt

SEQ ID NO: 35184 - DNA, 15 bp, Homo sapiens
cttactggcaagggt

SEQ ID NO: 35185 - DNA, 15 bp, Homo sapiens
acttactggcaaggg

SEQ ID NO: 35186 - DNA, 15 bp, Homo sapiens
cacttactggcaagg

SEQ ID NO: 35187 - DNA, 15 bp, Homo sapiens
ccacttactggcaag

SEQ ID NO: 35188 - DNA, 15 bp, Homo sapiens
accacttactggcaa

SEQ ID NO: 35189 - DNA, 15 bp, Homo sapiens
aaccacttactggca

SEQ ID NO: 35190 - DNA, 15 bp, Homo sapiens
caaccacttactggc

SEQ ID NO: 35191 - DNA, 15 bp, Homo sapiens
ccaaccacttactgg

SEQ ID NO: 35192 - DNA, 15 bp, Homo sapiens
cccaaccacttactg

SEQ ID NO: 35193 - DNA, 15 bp, Homo sapiens
acccaaccacttact

SEQ ID NO: 35194 - DNA, 15 bp, Homo sapiens
cacccaaccacttac

SEQ ID NO: 35195 - DNA, 15 bp, Homo sapiens
ccacccaaccactta

SEQ ID NO: 35196 - DNA, 15 bp, Homo sapiens
cccacccaaccactt

SEQ ID NO: 35197 - DNA, 15 bp, Homo sapiens
ccccacccaaccact

SEQ ID NO: 35198 - DNA, 15 bp, Homo sapiens
gccccacccaaccac

SEQ ID NO: 35199 - DNA, 15 bp, Homo sapiens
agccccacccaacca

SEQ ID NO: 35200 - DNA, 15 bp, Homo sapiens
aagccccacccaacc

SEQ ID NO: 35201 - DNA, 15 bp, Homo sapiens
caagccccacccaac

SEQ ID NO: 35202 - DNA, 15 bp, Homo sapiens
ccaagccccacccaa

SEQ ID NO: 35203 - DNA, 15 bp, Homo sapiens
cccaagccccaccca

SEQ ID NO: 35204 - DNA, 15 bp, Homo sapiens
tcccaagccccaccc

SEQ ID NO: 35205 - DNA, 15 bp, Homo sapiens
gtcccaagccccacc

SEQ ID NO: 35206 - DNA, 15 bp, Homo sapiens
ggtcccaagccccac

SEQ ID NO: 35207 - DNA, 15 bp, Homo sapiens
tggtcccaagcccca

SEQ ID NO: 35208 - DNA, 15 bp, Homo sapiens
ctggtcccaagcccc

SEQ ID NO: 35209 - DNA, 15 bp, Homo sapiens
gctggtcccaagccc

SEQ ID NO: 35210 - DNA, 15 bp, Homo sapiens
ggctggtcccaagcc

SEQ ID NO: 35211 - DNA, 15 bp, Homo sapiens
tggctggtcccaagc

SEQ ID NO: 35212 - DNA, 15 bp, Homo sapiens
gtggctggtcccaag

SEQ ID NO: 35213 - DNA, 15 bp, Homo sapiens
ggtggctggtcccaa

SEQ ID NO: 35214 - DNA, 15 bp, Homo sapiens
aggtggctggtccca

SEQ ID NO: 35215 - DNA, 15 bp, Homo sapiens
gaggtggctggtccc

SEQ ID NO: 35216 - DNA, 15 bp, Homo sapiens
ggaggtggctggtcc

SEQ ID NO: 35217 - DNA, 15 bp, Homo sapiens
aggaggtggctggtc

SEQ ID NO: 35218 - DNA, 15 bp, Homo sapiens
aaggaggtggctggt

SEQ ID NO: 35219 - DNA, 15 bp, Homo sapiens
gaaggaggtggctgg

SEQ ID NO: 35220 - DNA, 15 bp, Homo sapiens
ggaaggaggtggctg

SEQ ID NO: 35221 - DNA, 15 bp, Homo sapiens
tggaaggaggtggct

SEQ ID NO: 35222 - DNA, 15 bp, Homo sapiens
ctggaaggaggtggc

SEQ ID NO: 35223 - DNA, 15 bp, Homo sapiens
cctggaaggaggtgg

SEQ ID NO: 35224 - DNA, 15 bp, Homo sapiens
ccctggaaggaggtg

SEQ ID NO: 35225 - DNA, 15 bp, Homo sapiens
cccctggaaggaggt

SEQ ID NO: 35226 - DNA, 15 bp, Homo sapiens
tcccctggaaggagg

SEQ ID NO: 35227 - DNA, 15 bp, Homo sapiens
ctcccctggaaggag

SEQ ID NO: 35228 - DNA, 15 bp, Homo sapiens
cctcccctggaagga

SEQ ID NO: 35229 - DNA, 15 bp, Homo sapiens
gcctcccctggaagg

SEQ ID NO: 35230 - DNA, 15 bp, Homo sapiens
agcctcccctggaag

SEQ ID NO: 35231 - DNA, 15 bp, Homo sapiens
cagcctcccctggaa

SEQ ID NO: 35232 - DNA, 15 bp, Homo sapiens
ccagcctcccctgga

SEQ ID NO: 35233 - DNA, 15 bp, Homo sapiens
tccagcctcccctgg

SEQ ID NO: 35234 - DNA, 15 bp, Homo sapiens
ctccagcctcccctg

SEQ ID NO: 35235 - DNA, 15 bp, Homo sapiens
cctccagcctcccct

SEQ ID NO: 35236 - DNA, 15 bp, Homo sapiens
gcctccagcctcccc

SEQ ID NO: 35237 - DNA, 15 bp, Homo sapiens
cgcctccagcctccc

SEQ ID NO: 35238 - DNA, 15 bp, Homo sapiens
acgcctccagcctcc

SEQ ID NO: 35239 - DNA, 15 bp, Homo sapiens
cacgcctccagcctc

SEQ ID NO: 35240 - DNA, 15 bp, Homo sapiens
tcacgcctccagcct

SEQ ID NO: 35241 - DNA, 15 bp, Homo sapiens
gtcacgcctccagcc

SEQ ID NO: 35242 - DNA, 15 bp, Homo sapiens
tgtcacgcctccagc

SEQ ID NO: 35243 - DNA, 15 bp, Homo sapiens
gtgtcacgcctccag

SEQ ID NO: 35244 - DNA, 15 bp, Homo sapiens
cgtgtcacgcctcca

SEQ ID NO: 35245 - DNA, 15 bp, Homo sapiens
acgtgtcacgcctcc

SEQ ID NO: 35246 - DNA, 15 bp, Homo sapiens
gacgtgtcacgcctc

SEQ ID NO: 35247 - DNA, 15 bp, Homo sapiens
agacgtgtcacgcct

SEQ ID NO: 35248 - DNA, 15 bp, Homo sapiens
aagacgtgtcacgcc

SEQ ID NO: 35249 - DNA, 15 bp, Homo sapiens
gaagacgtgtcacgc

SEQ ID NO: 35250 - DNA, 15 bp, Homo sapiens
ggaagacgtgtcacg

SEQ ID NO: 35251 - DNA, 15 bp, Homo sapiens
gggaagacgtgtcac

SEQ ID NO: 35252 - DNA, 15 bp, Homo sapiens
agggaagacgtgtca

SEQ ID NO: 35253 - DNA, 15 bp, Homo sapiens
cagggaagacgtgtc

SEQ ID NO: 35254 - DNA, 15 bp, Homo sapiens
acagggaagacgtgt

SEQ ID NO: 35255 - DNA, 15 bp, Homo sapiens
cacagggaagacgtg

SEQ ID NO: 35256 - DNA, 15 bp, Homo sapiens
acacagggaagacgt

SEQ ID NO: 35257 - DNA, 15 bp, Homo sapiens
cacacagggaagacg

SEQ ID NO: 35258 - DNA, 15 bp, Homo sapiens
acacacagggaagac

SEQ ID NO: 35259 - DNA, 15 bp, Homo sapiens
gacacacagggaaga

SEQ ID NO: 35260 - DNA, 15 bp, Homo sapiens
tgacacacagggaag

SEQ ID NO: 35261 - DNA, 15 bp, Homo sapiens
ctgacacacagggaa

SEQ ID NO: 35262 - DNA, 15 bp, Homo sapiens
gctgacacacaggga

SEQ ID NO: 35263 - DNA, 15 bp, Homo sapiens
agctgacacacaggg

SEQ ID NO: 35264 - DNA, 15 bp, Homo sapiens
gagctgacacacagg

SEQ ID NO: 35265 - DNA, 15 bp, Homo sapiens
tgagctgacacacag

SEQ ID NO: 35266 - DNA, 15 bp, Homo sapiens
atgagctgacacaca

SEQ ID NO: 35267 - DNA, 15 bp, Homo sapiens
gatgagctgacacac

SEQ ID NO: 35268 - DNA, 15 bp, Homo sapiens
agatgagctgacaca

SEQ ID NO: 35269 - DNA, 15 bp, Homo sapiens
aagatgagctgacac

SEQ ID NO: 35270 - DNA, 15 bp, Homo sapiens
gaagatgagctgaca

SEQ ID NO: 35271 - DNA, 15 bp, Homo sapiens
ggaagatgagctgac

SEQ ID NO: 35272 - DNA, 15 bp, Homo sapiens
tggaagatgagctga

SEQ ID NO: 35273 - DNA, 15 bp, Homo sapiens
ctggaagatgagctg

SEQ ID NO: 35274 - DNA, 15 bp, Homo sapiens
tctggaagatgagct

SEQ ID NO: 35275 - DNA, 15 bp, Homo sapiens
atctggaagatgagc

SEQ ID NO: 35276 - DNA, 15 bp, Homo sapiens
gatctggaagatgag

SEQ ID NO: 35277 - DNA, 15 bp, Homo sapiens
tgatctggaagatga

SEQ ID NO: 35278 - DNA, 15 bp, Homo sapiens
gtgatctggaagatg

SEQ ID NO: 35279 - DNA, 15 bp, Homo sapiens
tgtgatctggaagat

SEQ ID NO: 35280 - DNA, 15 bp, Homo sapiens
gtgtgatctggaaga

SEQ ID NO: 35281 - DNA, 15 bp, Homo sapiens
ggtgtgatctggaag

SEQ ID NO: 35282 - DNA, 15 bp, Homo sapiens
cggtgtgatctggaa

SEQ ID NO: 35283 - DNA, 15 bp, Homo sapiens
gcggtgtgatctgga

SEQ ID NO: 35284 - DNA, 15 bp, Homo sapiens
agcggtgtgatctgg

SEQ ID NO: 35285 - DNA, 15 bp, Homo sapiens
cagcggtgtgatctg

SEQ ID NO: 35286 - DNA, 15 bp, Homo sapiens
tcagcggtgtgatct

SEQ ID NO: 35287 - DNA, 15 bp, Homo sapiens
ttcagcggtgtgatc

SEQ ID NO: 35288 - DNA, 15 bp, Homo sapiens
gttcagcggtgtgat

SEQ ID NO: 35289 - DNA, 15 bp, Homo sapiens
cgttcagcggtgtga

SEQ ID NO: 35290 - DNA, 15 bp, Homo sapiens
acgttcagcggtgtg

SEQ ID NO: 35291 - DNA, 15 bp, Homo sapiens
cacgttcagcggtgt

SEQ ID NO: 35292 - DNA, 15 bp, Homo sapiens
tcacgttcagcggtg

SEQ ID NO: 35293 - DNA, 15 bp, Homo sapiens
gtcacgttcagcggt

SEQ ID NO: 35294 - DNA, 15 bp, Homo sapiens
ggtcacgttcagcgg

SEQ ID NO: 35295 - DNA, 15 bp, Homo sapiens
gggtcacgttcagcg

SEQ ID NO: 35296 - DNA, 15 bp, Homo sapiens
tgggtcacgttcagc

SEQ ID NO: 35297 - DNA, 15 bp, Homo sapiens
ctgggtcacgttcag

SEQ ID NO: 35298 - DNA, 15 bp, Homo sapiens
actgggtcacgttca

SEQ ID NO: 35299 - DNA, 15 bp, Homo sapiens
cactgggtcacgttc

SEQ ID NO: 35300 - DNA, 15 bp, Homo sapiens
ccactgggtcacgtt

SEQ ID NO: 35301 - DNA, 15 bp, Homo sapiens
gccactgggtcacgt

SEQ ID NO: 35302 - DNA, 15 bp, Homo sapiens
agccactgggtcacg

SEQ ID NO: 35303 - DNA, 15 bp, Homo sapiens
cagccactgggtcac

SEQ ID NO: 35304 - DNA, 15 bp, Homo sapiens
tcagccactgggtca

SEQ ID NO: 35305 - DNA, 15 bp, Homo sapiens
atcagccactgggtc

SEQ ID NO: 35306 - DNA, 15 bp, Homo sapiens
catcagccactgggt

SEQ ID NO: 35307 - DNA, 15 bp, Homo sapiens
ccatcagccactggg

SEQ ID NO: 35308 - DNA, 15 bp, Homo sapiens
accatcagccactgg

SEQ ID NO: 35309 - DNA, 15 bp, Homo sapiens
caccatcagccactg

SEQ ID NO: 35310 - DNA, 15 bp, Homo sapiens
gcaccatcagccact

SEQ ID NO: 35311 - DNA, 15 bp, Homo sapiens
agcaccatcagccac

SEQ ID NO: 35312 - DNA, 15 bp, Homo sapiens
cagcaccatcagcca

SEQ ID NO: 35313 - DNA, 15 bp, Homo sapiens
tcagcaccatcagcc

SEQ ID NO: 35314 - DNA, 15 bp, Homo sapiens
ttcagcaccatcagc

SEQ ID NO: 35315 - DNA, 15 bp, Homo sapiens
tttcagcaccatcag

SEQ ID NO: 35316 - DNA, 15 bp, Homo sapiens
ttttcagcaccatca

SEQ ID NO: 35317 - DNA, 15 bp, Homo sapiens
attttcagcaccatc

SEQ ID NO: 35318 - DNA, 15 bp, Homo sapiens
gattttcagcaccat

SEQ ID NO: 35319 - DNA, 15 bp, Homo sapiens
agattttcagcacca

SEQ ID NO: 35320 - DNA, 15 bp, Homo sapiens
gagattttcagcacc

SEQ ID NO: 35321 - DNA, 15 bp, Homo sapiens
ggagattttcagcac

SEQ ID NO: 35322 - DNA, 15 bp, Homo sapiens
aggagattttcagca

SEQ ID NO: 35323 - DNA, 15 bp, Homo sapiens
aaggagattttcagc

SEQ ID NO: 35324 - DNA, 15 bp, Homo sapiens
caaggagattttcag

SEQ ID NO: 35325 - DNA, 15 bp, Homo sapiens
gcaaggagattttca

SEQ ID NO: 35326 - DNA, 15 bp, Homo sapiens
ggcaaggagattttc

SEQ ID NO: 35327 - DNA, 15 bp, Homo sapiens
gggcaaggagatttt

SEQ ID NO: 35328 - DNA, 15 bp, Homo sapiens
cgggcaaggagattt

SEQ ID NO: 35329 - DNA, 15 bp, Homo sapiens
acgggcaaggagatt

SEQ ID NO: 35330 - DNA, 15 bp, Homo sapiens
cacgggcaaggagat

SEQ ID NO: 35331 - DNA, 15 bp, Homo sapiens
tcacgggcaaggaga

SEQ ID NO: 35332 - DNA, 15 bp, Homo sapiens
atcacgggcaaggag

SEQ ID NO: 35333 - DNA, 15 bp, Homo sapiens
aatcacgggcaagga

SEQ ID NO: 35334 - DNA, 15 bp, Homo sapiens
gaatcacgggcaagg

SEQ ID NO: 35335 - DNA, 15 bp, Homo sapiens
agaatcacgggcaag

SEQ ID NO: 35336 - DNA, 15 bp, Homo sapiens
gagaatcacgggcaa

SEQ ID NO: 35337 - DNA, 15 bp, Homo sapiens
tgagaatcacgggca

SEQ ID NO: 35338 - DNA, 15 bp, Homo sapiens
atgagaatcacgggc

SEQ ID NO: 35339 - DNA, 15 bp, Homo sapiens
catgagaatcacggg

SEQ ID NO: 35340 - DNA, 15 bp, Homo sapiens
ccatgagaatcacgg

SEQ ID NO: 35341 - DNA, 15 bp, Homo sapiens
tccatgagaatcacg

SEQ ID NO: 35342 - DNA, 15 bp, Homo sapiens
atccatgagaatcac

SEQ ID NO: 35343 - DNA, 15 bp, Homo sapiens
catccatgagaatca

SEQ ID NO: 35344 - DNA, 15 bp, Homo sapiens
tcatccatgagaatc

SEQ ID NO: 35345 - DNA, 15 bp, Homo sapiens
ctcatccatgagaat

SEQ ID NO: 35346 - DNA, 15 bp, Homo sapiens
tctcatccatgagaa

SEQ ID NO: 35347 - DNA, 15 bp, Homo sapiens
gtctcatccatgaga

SEQ ID NO: 35348 - DNA, 15 bp, Homo sapiens
cgtctcatccatgag

SEQ ID NO: 35349 - DNA, 15 bp, Homo sapiens
gcgtctcatccatga

SEQ ID NO: 35350 - DNA, 15 bp, Homo sapiens
agcgtctcatccatg

SEQ ID NO: 35351 - DNA, 15 bp, Homo sapiens
gagcgtctcatccat

SEQ ID NO: 35352 - DNA, 15 bp, Homo sapiens
tgagcgtctcatcca

SEQ ID NO: 35353 - DNA, 15 bp, Homo sapiens
ttgagcgtctcatcc

SEQ ID NO: 35354 - DNA, 15 bp, Homo sapiens
cttgagcgtctcatc

SEQ ID NO: 35355 - DNA, 15 bp, Homo sapiens
acttgagcgtctcat

SEQ ID NO: 35356 - DNA, 15 bp, Homo sapiens
aacttgagcgtctca

SEQ ID NO: 35357 - DNA, 15 bp, Homo sapiens
aaacttgagcgtctc

SEQ ID NO: 35358 - DNA, 15 bp, Homo sapiens
caaacttgagcgtct

SEQ ID NO: 35359 - DNA, 15 bp, Homo sapiens
acaaacttgagcgtc

SEQ ID NO: 35360 - DNA, 15 bp, Homo sapiens
cacaaacttgagcgt

SEQ ID NO: 35361 - DNA, 15 bp, Homo sapiens
ccacaaacttgagcg

SEQ ID NO: 35362 - DNA, 15 bp, Homo sapiens
gccacaaacttgagc

SEQ ID NO: 35363 - DNA, 15 bp, Homo sapiens
ggccacaaacttgag

SEQ ID NO: 35364 - DNA, 15 bp, Homo sapiens
gggccacaaacttga

SEQ ID NO: 35365 - DNA, 15 bp, Homo sapiens
cgggccacaaacttg

SEQ ID NO: 35366 - DNA, 15 bp, Homo sapiens
gcgggccacaaactt

SEQ ID NO: 35367 - DNA, 15 bp, Homo sapiens
tgcgggccacaaact

SEQ ID NO: 35368 - DNA, 15 bp, Homo sapiens
ttgcgggccacaaac

SEQ ID NO: 35369 - DNA, 15 bp, Homo sapiens
gttgcgggccacaaa

SEQ ID NO: 35370 - DNA, 15 bp, Homo sapiens
agttgcgggccacaa

SEQ ID NO: 35371 - DNA, 15 bp, Homo sapiens
tagttgcgggccaca

SEQ ID NO: 35372 - DNA, 15 bp, Homo sapiens
gtagttgcgggccac

SEQ ID NO: 35373 - DNA, 15 bp, Homo sapiens
ggtagttgcgggcca

SEQ ID NO: 35374 - DNA, 15 bp, Homo sapiens
aggtagttgcgggcc

SEQ ID NO: 35375 - DNA, 15 bp, Homo sapiens
caggtagttgcgggc

SEQ ID NO: 35376 - DNA, 15 bp, Homo sapiens
ccaggtagttgcggg

SEQ ID NO: 35377 - DNA, 15 bp, Homo sapiens
tccaggtagttgcgg

SEQ ID NO: 35378 - DNA, 15 bp, Homo sapiens
ttccaggtagttgcg

SEQ ID NO: 35379 - DNA, 15 bp, Homo sapiens
gttccaggtagttgc

SEQ ID NO: 35380 - DNA, 15 bp, Homo sapiens
ggttccaggtagttg

SEQ ID NO: 35381 - DNA, 15 bp, Homo sapiens
aggttccaggtagtt

SEQ ID NO: 35382 - DNA, 15 bp, Homo sapiens
caggttccaggtagt

SEQ ID NO: 35383 - DNA, 15 bp, Homo sapiens
ccaggttccaggtag

SEQ ID NO: 35384 - DNA, 15 bp, Homo sapiens
accaggttccaggta

SEQ ID NO: 35385 - DNA, 15 bp, Homo sapiens
taccaggttccaggt

SEQ ID NO: 35386 - DNA, 15 bp, Homo sapiens
ttaccaggttccagg

SEQ ID NO: 35387 - DNA, 15 bp, Homo sapiens
tttaccaggttccag

SEQ ID NO: 35388 - DNA, 15 bp, Homo sapiens
ctttaccaggttcca

SEQ ID NO: 35389 - DNA, 15 bp, Homo sapiens
tctttaccaggttcc

SEQ ID NO: 35390 - DNA, 15 bp, Homo sapiens
ctctttaccaggttc

SEQ ID NO: 35391 - DNA, 15 bp, Homo sapiens
actctttaccaggtt

SEQ ID NO: 35392 - DNA, 15 bp, Homo sapiens
cactctttaccaggt

SEQ ID NO: 35393 - DNA, 15 bp, Homo sapiens
acactctttaccagg

SEQ ID NO: 35394 - DNA, 15 bp, Homo sapiens
cacactctttaccag

SEQ ID NO: 35395 - DNA, 15 bp, Homo sapiens
acacactctttacca

SEQ ID NO: 35396 - DNA, 15 bp, Homo sapiens
cacacactctttacc

SEQ ID NO: 35397 - DNA, 15 bp, Homo sapiens
gcacacactctttac

SEQ ID NO: 35398 - DNA, 15 bp, Homo sapiens
tgcacacactcttta

SEQ ID NO: 35399 - DNA, 15 bp, Homo sapiens
ctgcacacactcttt

SEQ ID NO: 35400 - DNA, 15 bp, Homo sapiens
gctgcacacactctt

SEQ ID NO: 35401 - DNA, 15 bp, Homo sapiens
ggctgcacacactct

SEQ ID NO: 35402 - DNA, 15 bp, Homo sapiens
aggctgcacacactc

SEQ ID NO: 35403 - DNA, 15 bp, Homo sapiens
caggctgcacacact

SEQ ID NO: 35404 - DNA, 15 bp, Homo sapiens
gcaggctgcacacac

SEQ ID NO: 35405 - DNA, 15 bp, Homo sapiens
ggcaggctgcacaca

SEQ ID NO: 35406 - DNA, 15 bp, Homo sapiens
tggcaggctgcacac

SEQ ID NO: 35407 - DNA, 15 bp, Homo sapiens
gtggcaggctgcaca

SEQ ID NO: 35408 - DNA, 15 bp, Homo sapiens
ggtggcaggctgcac

SEQ ID NO: 35409 - DNA, 15 bp, Homo sapiens
tggtggcaggctgca

SEQ ID NO: 35410 - DNA, 15 bp, Homo sapiens
ttggtggcaggctgc

SEQ ID NO: 35411 - DNA, 15 bp, Homo sapiens
tttggtggcaggctg

SEQ ID NO: 35412 - DNA, 15 bp, Homo sapiens
atttggtggcaggct

SEQ ID NO: 35413 - DNA, 15 bp, Homo sapiens
gatttggtggcaggc

SEQ ID NO: 35414 - DNA, 15 bp, Homo sapiens
ggatttggtggcagg

SEQ ID NO: 35415 - DNA, 15 bp, Homo sapiens
aggatttggtggcag

SEQ ID NO: 35416 - DNA, 15 bp, Homo sapiens
caggatttggtggca

SEQ ID NO: 35417 - DNA, 15 bp, Homo sapiens
gcaggatttggtggc

SEQ ID NO: 35418 - DNA, 15 bp, Homo sapiens
agcaggatttggtgg

SEQ ID NO: 35419 - DNA, 15 bp, Homo sapiens
gagcaggatttggtg

SEQ ID NO: 35420 - DNA, 15 bp, Homo sapiens
cgagcaggatttggt

SEQ ID NO: 35421 - DNA, 15 bp, Homo sapiens
acgagcaggatttgg

SEQ ID NO: 35422 - DNA, 15 bp, Homo sapiens
aacgagcaggatttg

SEQ ID NO: 35423 - DNA, 15 bp, Homo sapiens
gaacgagcaggattt

SEQ ID NO: 35424 - DNA, 15 bp, Homo sapiens
agaacgagcaggatt

SEQ ID NO: 35425 - DNA, 15 bp, Homo sapiens
gagaacgagcaggat

SEQ ID NO: 35426 - DNA, 15 bp, Homo sapiens
cgagaacgagcagga

SEQ ID NO: 35427 - DNA, 15 bp, Homo sapiens
ccgagaacgagcagg

SEQ ID NO: 35428 - DNA, 15 bp, Homo sapiens
gccgagaacgagcag

SEQ ID NO: 35429 - DNA, 15 bp, Homo sapiens
tgccgagaacgagca

SEQ ID NO: 35430 - DNA, 15 bp, Homo sapiens
atgccgagaacgagc

SEQ ID NO: 35431 - DNA, 15 bp, Homo sapiens
catgccgagaacgag

SEQ ID NO: 35432 - DNA, 15 bp, Homo sapiens
gcatgccgagaacga

SEQ ID NO: 35433 - DNA, 15 bp, Homo sapiens
tgcatgccgagaacg

SEQ ID NO: 35434 - DNA, 15 bp, Homo sapiens
gtgcatgccgagaac

SEQ ID NO: 35435 - DNA, 15 bp, Homo sapiens
ggtgcatgccgagaa

SEQ ID NO: 35436 - DNA, 15 bp, Homo sapiens
cggtgcatgccgaga

SEQ ID NO: 35437 - DNA, 15 bp, Homo sapiens
tcggtgcatgccgag

SEQ ID NO: 35438 - DNA, 15 bp, Homo sapiens
atcggtgcatgccga

SEQ ID NO: 35439 - DNA, 15 bp, Homo sapiens
catcggtgcatgccg

SEQ ID NO: 35440 - DNA, 15 bp, Homo sapiens
ccatcggtgcatgcc

SEQ ID NO: 35441 - DNA, 15 bp, Homo sapiens
cccatcggtgcatgc

SEQ ID NO: 35442 - DNA, 15 bp, Homo sapiens
tcccatcggtgcatg

SEQ ID NO: 35443 - DNA, 15 bp, Homo sapiens
atcccatcggtgcat

SEQ ID NO: 35444 - DNA, 15 bp, Homo sapiens
aatcccatcggtgca

SEQ ID NO: 35445 - DNA, 15 bp, Homo sapiens
aaatcccatcggtgc

SEQ ID NO: 35446 - DNA, 15 bp, Homo sapiens
gaaatcccatcggtg

SEQ ID NO: 35447 - DNA, 15 bp, Homo sapiens
ggaaatcccatcggt

SEQ ID NO: 35448 - DNA, 15 bp, Homo sapiens
aggaaatcccatcgg

SEQ ID NO: 35449 - DNA, 15 bp, Homo sapiens
caggaaatcccatcg

SEQ ID NO: 35450 - DNA, 15 bp, Homo sapiens
ccaggaaatcccatc

SEQ ID NO: 35451 - DNA, 15 bp, Homo sapiens
gccaggaaatcccat

SEQ ID NO: 35452 - DNA, 15 bp, Homo sapiens
ggccaggaaatccca

SEQ ID NO: 35453 - DNA, 15 bp, Homo sapiens
cggccaggaaatccc

SEQ ID NO: 35454 - DNA, 15 bp, Homo sapiens
acggccaggaaatcc

SEQ ID NO: 35455 - DNA, 15 bp, Homo sapiens
aacggccaggaaatc

SEQ ID NO: 35456 - DNA, 15 bp, Homo sapiens
aaacggccaggaaat

SEQ ID NO: 35457 - DNA, 15 bp, Homo sapiens
caaacggccaggaaa

SEQ ID NO: 35458 - DNA, 15 bp, Homo sapiens
acaaacggccaggaa

SEQ ID NO: 35459 - DNA, 15 bp, Homo sapiens
cacaaacggccagga

SEQ ID NO: 35460 - DNA, 15 bp, Homo sapiens
gcacaaacggccagg

SEQ ID NO: 35461 - DNA, 15 bp, Homo sapiens
agcacaaacggccag

SEQ ID NO: 35462 - DNA, 15 bp, Homo sapiens
cagcacaaacggcca

SEQ ID NO: 35463 - DNA, 15 bp, Homo sapiens
gcagcacaaacggcc

SEQ ID NO: 35464 - DNA, 15 bp, Homo sapiens
agcagcacaaacggc

SEQ ID NO: 35465 - DNA, 15 bp, Homo sapiens
gagcagcacaaacgg

SEQ ID NO: 35466 - DNA, 15 bp, Homo sapiens
tgagcagcacaaacg

SEQ ID NO: 35467 - DNA, 15 bp, Homo sapiens
atgagcagcacaaac

SEQ ID NO: 35468 - DNA, 15 bp, Homo sapiens
tatgagcagcacaaa

SEQ ID NO: 35469 - DNA, 15 bp, Homo sapiens
ttatgagcagcacaa

SEQ ID NO: 35470 - DNA, 15 bp, Homo sapiens
attatgagcagcaca

SEQ ID NO: 35471 - DNA, 15 bp, Homo sapiens
cattatgagcagcac

SEQ ID NO: 35472 - DNA, 15 bp, Homo sapiens
gcattatgagcagca

SEQ ID NO: 35473 - DNA, 15 bp, Homo sapiens
ggcattatgagcagc

SEQ ID NO: 35474 - DNA, 15 bp, Homo sapiens
gggcattatgagcag

SEQ ID NO: 35475 - DNA, 15 bp, Homo sapiens
ggggcattatgagca

SEQ ID NO: 35476 - DNA, 15 bp, Homo sapiens
aggggcattatgagc

SEQ ID NO: 35477 - DNA, 15 bp, Homo sapiens
caggggcattatgag

SEQ ID NO: 35478 - DNA, 15 bp, Homo sapiens
ccaggggcattatga

SEQ ID NO: 35479 - DNA, 15 bp, Homo sapiens
accaggggcattatg

SEQ ID NO: 35480 - DNA, 15 bp, Homo sapiens
caccaggggcattat

SEQ ID NO: 35481 - DNA, 15 bp, Homo sapiens
tcaccaggggcatta

SEQ ID NO: 35482 - DNA, 15 bp, Homo sapiens
atcaccaggggcatt

SEQ ID NO: 35483 - DNA, 15 bp, Homo sapiens
gatcaccaggggcat

SEQ ID NO: 35484 - DNA, 15 bp, Homo sapiens
agatcaccaggggca

SEQ ID NO: 35485 - DNA, 15 bp, Homo sapiens
cagatcaccaggggc

SEQ ID NO: 35486 - DNA, 15 bp, Homo sapiens
ccagatcaccagggg

SEQ ID NO: 35487 - DNA, 15 bp, Homo sapiens
cccagatcaccaggg

SEQ ID NO: 35488 - DNA, 15 bp, Homo sapiens
acccagatcaccagg

SEQ ID NO: 35489 - DNA, 15 bp, Homo sapiens
gacccagatcaccag

SEQ ID NO: 35490 - DNA, 15 bp, Homo sapiens
agacccagatcacca

SEQ ID NO: 35491 - DNA, 15 bp, Homo sapiens
tagacccagatcacc

SEQ ID NO: 35492 - DNA, 15 bp, Homo sapiens
atagacccagatcac

SEQ ID NO: 35493 - DNA, 15 bp, Homo sapiens
tatagacccagatca

SEQ ID NO: 35494 - DNA, 15 bp, Homo sapiens
ctatagacccagatc

SEQ ID NO: 35495 - DNA, 15 bp, Homo sapiens
gctatagacccagat

SEQ ID NO: 35496 - DNA, 15 bp, Homo sapiens
tgctatagacccaga

SEQ ID NO: 35497 - DNA, 15 bp, Homo sapiens
gtgctatagacccag

SEQ ID NO: 35498 - DNA, 15 bp, Homo sapiens
tgtgctatagaccca

SEQ ID NO: 35499 - DNA, 15 bp, Homo sapiens
ctgtgctatagaccc

SEQ ID NO: 35500 - DNA, 15 bp, Homo sapiens
tctgtgctatagacc

SEQ ID NO: 35501 - DNA, 15 bp, Homo sapiens
gtctgtgctatagac

SEQ ID NO: 35502 - DNA, 15 bp, Homo sapiens
tgtctgtgctataga

SEQ ID NO: 35503 - DNA, 15 bp, Homo sapiens
gtgtctgtgctatag

SEQ ID NO: 35504 - DNA, 15 bp, Homo sapiens
agtgtctgtgctata

SEQ ID NO: 35505 - DNA, 15 bp, Homo sapiens
tagtgtctgtgctat

SEQ ID NO: 35506 - DNA, 15 bp, Homo sapiens
ttagtgtctgtgcta

SEQ ID NO: 35507 - DNA, 15 bp, Homo sapiens
gttagtgtctgtgct

SEQ ID NO: 35508 - DNA, 15 bp, Homo sapiens
agttagtgtctgtgc

SEQ ID NO: 35509 - DNA, 15 bp, Homo sapiens
aagttagtgtctgtg

SEQ ID NO: 35510 - DNA, 15 bp, Homo sapiens
aaagttagtgtctgt

SEQ ID NO: 35511 - DNA, 15 bp, Homo sapiens
taaagttagtgtctg

SEQ ID NO: 35512 - DNA, 15 bp, Homo sapiens
ctaaagttagtgtct

SEQ ID NO: 35513 - DNA, 15 bp, Homo sapiens
gctaaagttagtgtc

SEQ ID NO: 35514 - DNA, 15 bp, Homo sapiens
cgctaaagttagtgt

SEQ ID NO: 35515 - DNA, 15 bp, Homo sapiens
tcgctaaagttagtg

SEQ ID NO: 35516 - DNA, 15 bp, Homo sapiens
atcgctaaagttagt

SEQ ID NO: 35517 - DNA, 15 bp, Homo sapiens
tatcgctaaagttag

SEQ ID NO: 35518 - DNA, 15 bp, Homo sapiens
atatcgctaaagtta

SEQ ID NO: 35519 - DNA, 15 bp, Homo sapiens
catatcgctaaagtt

SEQ ID NO: 35520 - DNA, 15 bp, Homo sapiens
acatatcgctaaagt

SEQ ID NO: 35521 - DNA, 15 bp, Homo sapiens
aacatatcgctaaag

SEQ ID NO: 35522 - DNA, 15 bp, Homo sapiens
gaacatatcgctaaa

SEQ ID NO: 35523 - DNA, 15 bp, Homo sapiens
agaacatatcgctaa

SEQ ID NO: 35524 - DNA, 15 bp, Homo sapiens
cagaacatatcgcta

SEQ ID NO: 35525 - DNA, 15 bp, Homo sapiens
ccagaacatatcgct

SEQ ID NO: 35526 - DNA, 15 bp, Homo sapiens
accagaacatatcgc

SEQ ID NO: 35527 - DNA, 15 bp, Homo sapiens
gaccagaacatatcg

SEQ ID NO: 35528 - DNA, 15 bp, Homo sapiens
agaccagaacatatc

SEQ ID NO: 35529 - DNA, 15 bp, Homo sapiens
aagaccagaacatat

SEQ ID NO: 35530 - DNA, 15 bp, Homo sapiens
caagaccagaacata

SEQ ID NO: 35531 - DNA, 15 bp, Homo sapiens
tcaagaccagaacat

SEQ ID NO: 35532 - DNA, 15 bp, Homo sapiens
gtcaagaccagaaca

SEQ ID NO: 35533 - DNA, 15 bp, Homo sapiens
agtcaagaccagaac

SEQ ID NO: 35534 - DNA, 15 bp, Homo sapiens
cagtcaagaccagaa

SEQ ID NO: 35535 - DNA, 15 bp, Homo sapiens
tcagtcaagaccaga

SEQ ID NO: 35536 - DNA, 15 bp, Homo sapiens
gtcagtcaagaccag

SEQ ID NO: 35537 - DNA, 15 bp, Homo sapiens
tgtcagtcaagacca

SEQ ID NO: 35538 - DNA, 15 bp, Homo sapiens
ctgtcagtcaagacc

SEQ ID NO: 35539 - DNA, 15 bp, Homo sapiens
actgtcagtcaagac

SEQ ID NO: 35540 - DNA, 15 bp, Homo sapiens
aactgtcagtcaaga

SEQ ID NO: 35541 - DNA, 15 bp, Homo sapiens
aaactgtcagtcaag

SEQ ID NO: 35542 - DNA, 15 bp, Homo sapiens
aaaactgtcagtcaa

SEQ ID NO: 35543 - DNA, 15 bp, Homo sapiens
gaaaactgtcagtca

SEQ ID NO: 35544 - DNA, 15 bp, Homo sapiens
ggaaaactgtcagtc

SEQ ID NO: 35545 - DNA, 15 bp, Homo sapiens
tggaaaactgtcagt

SEQ ID NO: 35546 - DNA, 15 bp, Homo sapiens
atggaaaactgtcag

SEQ ID NO: 35547 - DNA, 15 bp, Homo sapiens
tatggaaaactgtca

SEQ ID NO: 35548 - DNA, 15 bp, Homo sapiens
ttatggaaaactgtc

SEQ ID NO: 35549 - DNA, 15 bp, Homo sapiens
tttatggaaaactgt

SEQ ID NO: 35550 - DNA, 15 bp, Homo sapiens
ctttatggaaaactg

SEQ ID NO: 35551 - DNA, 15 bp, Homo sapiens
tctttatggaaaact

SEQ ID NO: 35552 - DNA, 15 bp, Homo sapiens
ttctttatggaaaac

SEQ ID NO: 35553 - DNA, 15 bp, Homo sapiens
cttctttatggaaaa

SEQ ID NO: 35554 - DNA, 15 bp, Homo sapiens
tcttctttatggaaa

SEQ ID NO: 35555 - DNA, 15 bp, Homo sapiens
atcttctttatggaa

SEQ ID NO: 35556 - DNA, 15 bp, Homo sapiens
catcttctttatgga

SEQ ID NO: 35557 - DNA, 15 bp, Homo sapiens
acatcttctttatgg

SEQ ID NO: 35558 - DNA, 15 bp, Homo sapiens
aacatcttctttatg

SEQ ID NO: 35559 - DNA, 15 bp, Homo sapiens
aaacatcttctttat

SEQ ID NO: 35560 - DNA, 15 bp, Homo sapiens
taaacatcttcttta

SEQ ID NO: 35561 - DNA, 15 bp, Homo sapiens
ttaaacatcttcttt

SEQ ID NO: 35562 - DNA, 15 bp, Homo sapiens
gttaaacatcttctt

SEQ ID NO: 35563 - DNA, 15 bp, Homo sapiens
agttaaacatcttct

SEQ ID NO: 35564 - DNA, 15 bp, Homo sapiens
aagttaaacatcttc

SEQ ID NO: 35565 - DNA, 15 bp, Homo sapiens
taagttaaacatctt

SEQ ID NO: 35566 - DNA, 15 bp, Homo sapiens
ttaagttaaacatct

SEQ ID NO: 35567 - DNA, 15 bp, Homo sapiens
attaagttaaacatc

SEQ ID NO: 35568 - DNA, 15 bp, Homo sapiens
gattaagttaaacat

SEQ ID NO: 35569 - DNA, 15 bp, Homo sapiens
tgattaagttaaaca

SEQ ID NO: 35570 - DNA, 15 bp, Homo sapiens
ttgattaagttaaac

SEQ ID NO: 35571 - DNA, 15 bp, Homo sapiens
attgattaagttaaa

SEQ ID NO: 35572 - DNA, 15 bp, Homo sapiens
aattgattaagttaa

SEQ ID NO: 35573 - DNA, 15 bp, Homo sapiens
taattgattaagtta

SEQ ID NO: 35574 - DNA, 15 bp, Homo sapiens
ttaattgattaagtt

SEQ ID NO: 35575 - DNA, 15 bp, Homo sapiens
attaattgattaagt

SEQ ID NO: 35576 - DNA, 15 bp, Homo sapiens
aattaattgattaag

SEQ ID NO: 35577 - DNA, 15 bp, Homo sapiens
aaattaattgattaa

SEQ ID NO: 35578 - DNA, 15 bp, Homo sapiens
aaaattaattgatta

SEQ ID NO: 35579 - DNA, 15 bp, Homo sapiens
aaaaattaattgatt

SEQ ID NO: 35580 - DNA, 15 bp, Homo sapiens
aaaaaattaattgat

SEQ ID NO: 35581 - DNA, 15 bp, Homo sapiens
aaaaaaattaattga

SEQ ID NO: 35582 - DNA, 15 bp, Homo sapiens
taaaaaaattaattg

SEQ ID NO: 35583 - DNA, 15 bp, Homo sapiens
ataaaaaaattaatt

SEQ ID NO: 35584 - DNA, 15 bp, Homo sapiens
aataaaaaaattaat

SEQ ID NO: 35585 - DNA, 15 bp, Homo sapiens
caataaaaaaattaa

SEQ ID NO: 35586 - DNA, 15 bp, Homo sapiens
acaataaaaaaatta

SEQ ID NO: 35587 - DNA, 15 bp, Homo sapiens
aacaataaaaaaatt

SEQ ID NO: 35588 - DNA, 15 bp, Homo sapiens
aaacaataaaaaaat

SEQ ID NO: 35589 - DNA, 15 bp, Homo sapiens
taaacaataaaaaaa

SEQ ID NO: 35590 - DNA, 15 bp, Homo sapiens
ttaaacaataaaaaa

SEQ ID NO: 35591 - DNA, 15 bp, Homo sapiens
tttaaacaataaaaa

SEQ ID NO: 35592 - DNA, 15 bp, Homo sapiens
ctttaaacaataaaa

SEQ ID NO: 35593 - DNA, 15 bp, Homo sapiens
gctttaaacaataaa

SEQ ID NO: 35594 - DNA, 15 bp, Homo sapiens
tgctttaaacaataa

SEQ ID NO: 35595 - DNA, 15 bp, Homo sapiens
ttgctttaaacaata

SEQ ID NO: 35596 - DNA, 15 bp, Homo sapiens
gttgctttaaacaat

SEQ ID NO: 35597 - DNA, 15 bp, Homo sapiens
agttgctttaaacaa

SEQ ID NO: 35598 - DNA, 15 bp, Homo sapiens
cagttgctttaaaca

SEQ ID NO: 35599 - DNA, 15 bp, Homo sapiens
acagttgctttaaac

SEQ ID NO: 35600 - DNA, 15 bp, Homo sapiens
gacagttgctttaaa

SEQ ID NO: 35601 - DNA, 15 bp, Homo sapiens
agacagttgctttaa

SEQ ID NO: 35602 - DNA, 15 bp, Homo sapiens
tagacagttgcttta

SEQ ID NO: 35603 - DNA, 15 bp, Homo sapiens
atagacagttgcttt

SEQ ID NO: 35604 - DNA, 15 bp, Homo sapiens
aatagacagttgctt

SEQ ID NO: 35605 - DNA, 15 bp, Homo sapiens
aaatagacagttgct

SEQ ID NO: 35606 - DNA, 15 bp, Homo sapiens
gaaatagacagttgc

SEQ ID NO: 35607 - DNA, 15 bp, Homo sapiens
agaaatagacagttg

SEQ ID NO: 35608 - DNA, 15 bp, Homo sapiens
cagaaatagacagtt

SEQ ID NO: 35609 - DNA, 15 bp, Homo sapiens
gcagaaatagacagt

SEQ ID NO: 35610 - DNA, 15 bp, Homo sapiens
agcagaaatagacag

SEQ ID NO: 35611 - DNA, 15 bp, Homo sapiens
cagcagaaatagaca

SEQ ID NO: 35612 - DNA, 15 bp, Homo sapiens
tcagcagaaatagac

SEQ ID NO: 35613 - DNA, 15 bp, Homo sapiens
ttcagcagaaataga

SEQ ID NO: 35614 - DNA, 15 bp, Homo sapiens
attcagcagaaatag

SEQ ID NO: 35615 - DNA, 15 bp, Homo sapiens
aattcagcagaaata

SEQ ID NO: 35616 - DNA, 15 bp, Homo sapiens
aaattcagcagaaat

SEQ ID NO: 35617 - DNA, 15 bp, Homo sapiens
aaaattcagcagaaa

SEQ ID NO: 35618 - DNA, 15 bp, Homo sapiens
gaaaattcagcagaa

SEQ ID NO: 35619 - DNA, 15 bp, Homo sapiens
tgaaaattcagcaga

SEQ ID NO: 35620 - DNA, 15 bp, Homo sapiens
gtgaaaattcagcag

SEQ ID NO: 35621 - DNA, 15 bp, Homo sapiens
tgtgaaaattcagca

SEQ ID NO: 35622 - DNA, 15 bp, Homo sapiens
atgtgaaaattcagc

SEQ ID NO: 35623 - DNA, 15 bp, Homo sapiens
catgtgaaaattcag

SEQ ID NO: 35624 - DNA, 15 bp, Homo sapiens
tcatgtgaaaattca

SEQ ID NO: 35625 - DNA, 15 bp, Homo sapiens
ttcatgtgaaaattc

SEQ ID NO: 35626 - DNA, 15 bp, Homo sapiens
gttcatgtgaaaatt

SEQ ID NO: 35627 - DNA, 15 bp, Homo sapiens
tgttcatgtgaaaat

SEQ ID NO: 35628 - DNA, 15 bp, Homo sapiens
atgttcatgtgaaaa

SEQ ID NO: 35629 - DNA, 15 bp, Homo sapiens
tatgttcatgtgaaa

SEQ ID NO: 35630 - DNA, 15 bp, Homo sapiens
gtatgttcatgtgaa

SEQ ID NO: 35631 - DNA, 15 bp, Homo sapiens
agtatgttcatgtga

SEQ ID NO: 35632 - DNA, 15 bp, Homo sapiens
cagtatgttcatgtg

SEQ ID NO: 35633 - DNA, 15 bp, Homo sapiens
ccagtatgttcatgt

SEQ ID NO: 35634 - DNA, 15 bp, Homo sapiens
gccagtatgttcatg

SEQ ID NO: 35635 - DNA, 15 bp, Homo sapiens
agccagtatgttcat

SEQ ID NO: 35636 - DNA, 15 bp, Homo sapiens
cagccagtatgttca

SEQ ID NO: 35637 - DNA, 15 bp, Homo sapiens
ccagccagtatgttc

SEQ ID NO: 35638 - DNA, 15 bp, Homo sapiens
accagccagtatgtt

SEQ ID NO: 35639 - DNA, 15 bp, Homo sapiens
caccagccagtatgt

SEQ ID NO: 35640 - DNA, 15 bp, Homo sapiens
tcaccagccagtatg

SEQ ID NO: 35641 - DNA, 15 bp, Homo sapiens
atcaccagccagtat

SEQ ID NO: 35642 - DNA, 15 bp, Homo sapiens
catcaccagccagta

SEQ ID NO: 35643 - DNA, 15 bp, Homo sapiens
ccatcaccagccagt

SEQ ID NO: 35644 - DNA, 15 bp, Homo sapiens
tccatcaccagccag

SEQ ID NO: 35645 - DNA, 15 bp, Homo sapiens
ctccatcaccagcca

SEQ ID NO: 35646 - DNA, 15 bp, Homo sapiens
cctccatcaccagcc

SEQ ID NO: 35647 - DNA, 15 bp, Homo sapiens
acctccatcaccagc

SEQ ID NO: 35648 - DNA, 15 bp, Homo sapiens
aacctccatcaccag

SEQ ID NO: 35649 - DNA, 15 bp, Homo sapiens
aaacctccatcacca

SEQ ID NO: 35650 - DNA, 15 bp, Homo sapiens
gaaacctccatcacc

SEQ ID NO: 35651 - DNA, 15 bp, Homo sapiens
tgaaacctccatcac

SEQ ID NO: 35652 - DNA, 15 bp, Homo sapiens
atgaaacctccatca

SEQ ID NO: 35653 - DNA, 15 bp, Homo sapiens
tatgaaacctccatc

SEQ ID NO: 35654 - DNA, 15 bp, Homo sapiens
gtatgaaacctccat

SEQ ID NO: 35655 - DNA, 15 bp, Homo sapiens
agtatgaaacctcca

SEQ ID NO: 35656 - DNA, 15 bp, Homo sapiens
gagtatgaaacctcc

SEQ ID NO: 35657 - DNA, 15 bp, Homo sapiens
agagtatgaaacctc

SEQ ID NO: 35658 - DNA, 15 bp, Homo sapiens
tagagtatgaaacct

SEQ ID NO: 35659 - DNA, 15 bp, Homo sapiens
ctagagtatgaaacc

SEQ ID NO: 35660 - DNA, 15 bp, Homo sapiens
tctagagtatgaaac

SEQ ID NO: 35661 - DNA, 15 bp, Homo sapiens
atctagagtatgaaa

SEQ ID NO: 35662 - DNA, 15 bp, Homo sapiens
aatctagagtatgaa

SEQ ID NO: 35663 - DNA, 15 bp, Homo sapiens
aaatctagagtatga

SEQ ID NO: 35664 - DNA, 15 bp, Homo sapiens
aaaatctagagtatg

SEQ ID NO: 35665 - DNA, 15 bp, Homo sapiens
caaaatctagagtat

SEQ ID NO: 35666 - DNA, 15 bp, Homo sapiens
acaaaatctagagta

SEQ ID NO: 35667 - DNA, 15 bp, Homo sapiens
aacaaaatctagagt

SEQ ID NO: 35668 - DNA, 15 bp, Homo sapiens
aaacaaaatctagag

SEQ ID NO: 35669 - DNA, 15 bp, Homo sapiens
aaaacaaaatctaga

SEQ ID NO: 35670 - DNA, 15 bp, Homo sapiens
caaaacaaaatctag

SEQ ID NO: 35671 - DNA, 15 bp, Homo sapiens
gcaaaacaaaatcta

SEQ ID NO: 35672 - DNA, 15 bp, Homo sapiens
agcaaaacaaaatct

SEQ ID NO: 35673 - DNA, 15 bp, Homo sapiens
aagcaaaacaaaatc

SEQ ID NO: 35674 - DNA, 15 bp, Homo sapiens
aaagcaaaacaaaat

SEQ ID NO: 35675 - DNA, 15 bp, Homo sapiens
aaaagcaaaacaaaa

SEQ ID NO: 35676 - DNA, 15 bp, Homo sapiens
aaaaagcaaaacaaa

SEQ ID NO: 35677 - DNA, 15 bp, Homo sapiens
gaaaaagcaaaacaa

SEQ ID NO: 35678 - DNA, 15 bp, Homo sapiens
agaaaaagcaaaaca

SEQ ID NO: 35679 - DNA, 15 bp, Homo sapiens
cagaaaaagcaaaac

SEQ ID NO: 35680 - DNA, 15 bp, Homo sapiens
tcagaaaaagcaaaa

SEQ ID NO: 35681 - DNA, 15 bp, Homo sapiens
gtcagaaaaagcaaa

SEQ ID NO: 35682 - DNA, 15 bp, Homo sapiens
agtcagaaaaagcaa

SEQ ID NO: 35683 - DNA, 15 bp, Homo sapiens
gagtcagaaaaagca

SEQ ID NO: 35684 - DNA, 15 bp, Homo sapiens
ggagtcagaaaaagc

SEQ ID NO: 35685 - DNA, 15 bp, Homo sapiens
tggagtcagaaaaag

SEQ ID NO: 35686 - DNA, 15 bp, Homo sapiens
ctggagtcagaaaaa

SEQ ID NO: 35687 - DNA, 15 bp, Homo sapiens
actggagtcagaaaa

SEQ ID NO: 35688 - DNA, 15 bp, Homo sapiens
cactggagtcagaaa

SEQ ID NO: 35689 - DNA, 15 bp, Homo sapiens
ccactggagtcagaa

SEQ ID NO: 35690 - DNA, 15 bp, Homo sapiens
cccactggagtcaga

SEQ ID NO: 35691 - DNA, 15 bp, Homo sapiens
ccccactggagtcag

SEQ ID NO: 35692 - DNA, 15 bp, Homo sapiens
gccccactggagtca

SEQ ID NO: 35693 - DNA, 15 bp, Homo sapiens
tgccccactggagtc

SEQ ID NO: 35694 - DNA, 15 bp, Homo sapiens
ttgccccactggagt

SEQ ID NO: 35695 - DNA, 15 bp, Homo sapiens
cttgccccactggag

SEQ ID NO: 35696 - DNA, 15 bp, Homo sapiens
tcttgccccactgga

SEQ ID NO: 35697 - DNA, 15 bp, Homo sapiens
atcttgccccactgg

SEQ ID NO: 35698 - DNA, 15 bp, Homo sapiens
aatcttgccccactg

SEQ ID NO: 35699 - DNA, 15 bp, Homo sapiens
aaatcttgccccact

SEQ ID NO: 35700 - DNA, 15 bp, Homo sapiens
aaaatcttgccccac

SEQ ID NO: 35701 - DNA, 15 bp, Homo sapiens
gaaaatcttgcccca

SEQ ID NO: 35702 - DNA, 15 bp, Homo sapiens
ggaaaatcttgcccc

SEQ ID NO: 35703 - DNA, 15 bp, Homo sapiens
aggaaaatcttgccc

SEQ ID NO: 35704 - DNA, 15 bp, Homo sapiens
aaggaaaatcttgcc

SEQ ID NO: 35705 - DNA, 15 bp, Homo sapiens
aaaggaaaatcttgc

SEQ ID NO: 35706 - DNA, 15 bp, Homo sapiens
aaaaggaaaatcttg

SEQ ID NO: 35707 - DNA, 15 bp, Homo sapiens
aaaaaggaaaatctt

SEQ ID NO: 35708 - DNA, 15 bp, Homo sapiens
aaaaaaggaaaatct

SEQ ID NO: 35709 - DNA, 15 bp, Homo sapiens
taaaaaaggaaaatc

SEQ ID NO: 35710 - DNA, 15 bp, Homo sapiens
ataaaaaaggaaaat

SEQ ID NO: 35711 - DNA, 15 bp, Homo sapiens
tataaaaaaggaaaa

SEQ ID NO: 35712 - DNA, 15 bp, Homo sapiens
gtataaaaaaggaaa

SEQ ID NO: 35713 - DNA, 15 bp, Homo sapiens
tgtataaaaaaggaa

SEQ ID NO: 35714 - DNA, 15 bp, Homo sapiens
gtgtataaaaaagga

SEQ ID NO: 35715 - DNA, 15 bp, Homo sapiens
tgtgtataaaaaagg

SEQ ID NO: 35716 - DNA, 15 bp, Homo sapiens
atgtgtataaaaaag

SEQ ID NO: 35717 - DNA, 15 bp, Homo sapiens
ttatgtgtataaaaa

SEQ ID NO: 35718 - DNA, 15 bp, Homo sapiens
attatgtgtataaaa

SEQ ID NO: 35719 - DNA, 15 bp, Homo sapiens
aattatgtgtataaa

SEQ ID NO: 35720 - DNA, 15 bp, Homo sapiens
taattatgtgtataa

SEQ ID NO: 35721 - DNA, 15 bp, Homo sapiens
ttaattatgtgtata

SEQ ID NO: 35722 - DNA, 15 bp, Homo sapiens
tttaattatgtgtat

SEQ ID NO: 35723 - DNA, 15 bp, Homo sapiens
ctttaattatgtgta

SEQ ID NO: 35724 - DNA, 15 bp, Homo sapiens
actttaattatgtgt

SEQ ID NO: 35725 - DNA, 15 bp, Homo sapiens
cactttaattatgtg

SEQ ID NO: 35726 - DNA, 15 bp, Homo sapiens
acactttaattatgt

SEQ ID NO: 35727 - DNA, 15 bp, Homo sapiens
gacactttaattatg

SEQ ID NO: 35728 - DNA, 15 bp, Homo sapiens
ggacactttaattat

SEQ ID NO: 35729 - DNA, 15 bp, Homo sapiens
tggacactttaatta

SEQ ID NO: 35730 - DNA, 15 bp, Homo sapiens
atggacactttaatt

SEQ ID NO: 35731 - DNA, 15 bp, Homo sapiens
aatggacactttaat

SEQ ID NO: 35732 - DNA, 15 bp, Homo sapiens
caatggacactttaa

SEQ ID NO: 35733 - DNA, 15 bp, Homo sapiens
tcaatggacacttta

SEQ ID NO: 35734 - DNA, 15 bp, Homo sapiens
gtcaatggacacttt

SEQ ID NO: 35735 - DNA, 15 bp, Homo sapiens
tgtcaatggacactt

SEQ ID NO: 35736 - DNA, 15 bp, Homo sapiens
atgtcaatggacact

SEQ ID NO: 35737 - DNA, 15 bp, Homo sapiens
catgtcaatggacac

SEQ ID NO: 35738 - DNA, 15 bp, Homo sapiens
acatgtcaatggaca

SEQ ID NO: 35739 - DNA, 15 bp, Homo sapiens
tacatgtcaatggac

SEQ ID NO: 35740 - DNA, 15 bp, Homo sapiens
gtacatgtcaatgga

SEQ ID NO: 35741 - DNA, 15 bp, Homo sapiens
tgtacatgtcaatgg

SEQ ID NO: 35742 - DNA, 15 bp, Homo sapiens
ctgtacatgtcaatg

SEQ ID NO: 35743 - DNA, 15 bp, Homo sapiens
tctgtacatgtcaat

SEQ ID NO: 35744 - DNA, 15 bp, Homo sapiens
ctctgtacatgtcaa

SEQ ID NO: 35745 - DNA, 15 bp, Homo sapiens
tctctgtacatgtca

SEQ ID NO: 35746 - DNA, 15 bp, Homo sapiens
ttctctgtacatgtc

SEQ ID NO: 35747 - DNA, 15 bp, Homo sapiens
gttctctgtacatgt

SEQ ID NO: 35748 - DNA, 15 bp, Homo sapiens
agttctctgtacatg

SEQ ID NO: 35749 - DNA, 15 bp, Homo sapiens
tagttctctgtacat

SEQ ID NO: 35750 - DNA, 15 bp, Homo sapiens
ttagttctctgtaca

SEQ ID NO: 35751 - DNA, 15 bp, Homo sapiens
gttagttctctgtac

SEQ ID NO: 35752 - DNA, 15 bp, Homo sapiens
tgttagttctctgta

SEQ ID NO: 35753 - DNA, 15 bp, Homo sapiens
gtgttagttctctgt

SEQ ID NO: 35754 - DNA, 15 bp, Homo sapiens
agtgttagttctctg

SEQ ID NO: 35755 - DNA, 15 bp, Homo sapiens
tagtgttagttctct

SEQ ID NO: 35756 - DNA, 15 bp, Homo sapiens
atagtgttagttctc

SEQ ID NO: 35757 - DNA, 15 bp, Homo sapiens
aatagtgttagttct

SEQ ID NO: 35758 - DNA, 15 bp, Homo sapiens
aaatagtgttagttc

SEQ ID NO: 35759 - DNA, 15 bp, Homo sapiens
aaaatagtgttagtt

SEQ ID NO: 35760 - DNA, 15 bp, Homo sapiens
taaaatagtgttagt

SEQ ID NO: 35761 - DNA, 15 bp, Homo sapiens
ataaaatagtgttag

SEQ ID NO: 35762 - DNA, 15 bp, Homo sapiens
cataaaatagtgtta

SEQ ID NO: 35763 - DNA, 15 bp, Homo sapiens
gcataaaatagtgtt

SEQ ID NO: 35764 - DNA, 15 bp, Homo sapiens
tgcataaaatagtgt

SEQ ID NO: 35765 - DNA, 15 bp, Homo sapiens
ttgcataaaatagtg

SEQ ID NO: 35766 - DNA, 15 bp, Homo sapiens
tttgcataaaatagt

SEQ ID NO: 35767 - DNA, 15 bp, Homo sapiens
atttgcataaaatag

SEQ ID NO: 35768 - DNA, 15 bp, Homo sapiens
tatttgcataaaata

SEQ ID NO: 35769 - DNA, 15 bp, Homo sapiens
atatttgcataaaat

SEQ ID NO: 35770 - DNA, 15 bp, Homo sapiens
aatatttgcataaaa

SEQ ID NO: 35771 - DNA, 15 bp, Homo sapiens
aaatatttgcataaa

SEQ ID NO: 35772 - DNA, 15 bp, Homo sapiens
aaaatatttgcataa

SEQ ID NO: 35773 - DNA, 15 bp, Homo sapiens
aaaaatatttgcata

SEQ ID NO: 35774 - DNA, 15 bp, Homo sapiens
aaaaaatatttgcat

SEQ ID NO: 35775 - DNA, 15 bp, Homo sapiens
aaaaaaatatttgca

SEQ ID NO: 35776 - DNA, 15 bp, Homo sapiens
caaaaaaatatttgc

SEQ ID NO: 35777 - DNA, 15 bp, Homo sapiens
acaaaaaaatatttg

SEQ ID NO: 35778 - DNA, 15 bp, Homo sapiens
tacaaaaaaatattt

SEQ ID NO: 35779 - DNA, 15 bp, Homo sapiens
ctacaaaaaaatatt

SEQ ID NO: 35780 - DNA, 15 bp, Homo sapiens
tctacaaaaaaatat

SEQ ID NO: 35781 - DNA, 15 bp, Homo sapiens
atctacaaaaaaata

SEQ ID NO: 35782 - DNA, 15 bp, Homo sapiens
catctacaaaaaaat

SEQ ID NO: 35783 - DNA, 15 bp, Homo sapiens
tcatctacaaaaaaa

SEQ ID NO: 35784 - DNA, 15 bp, Homo sapiens
ttcatctacaaaaaa

SEQ ID NO: 35785 - DNA, 15 bp, Homo sapiens
tttcatctacaaaaa

SEQ ID NO: 35786 - DNA, 15 bp, Homo sapiens
ttttcatctacaaaa

SEQ ID NO: 35787 - DNA, 15 bp, Homo sapiens
tttttcatctacaaa

SEQ ID NO: 35788 - DNA, 15 bp, Homo sapiens
ctttttcatctacaa

SEQ ID NO: 35789 - DNA, 15 bp, Homo sapiens
gctttttcatctaca

SEQ ID NO: 35790 - DNA, 15 bp, Homo sapiens
tgctttttcatctac

SEQ ID NO: 35791 - DNA, 15 bp, Homo sapiens
atgctttttcatcta

SEQ ID NO: 35792 - DNA, 15 bp, Homo sapiens
catgctttttcatct

SEQ ID NO: 35793 - DNA, 15 bp, Homo sapiens
acatgctttttcatc

SEQ ID NO: 35794 - DNA, 15 bp, Homo sapiens
tacatgctttttcat

SEQ ID NO: 35795 - DNA, 15 bp, Homo sapiens
gtacatgctttttca

SEQ ID NO: 35796 - DNA, 15 bp, Homo sapiens
tgtacatgctttttc

SEQ ID NO: 35797 - DNA, 15 bp, Homo sapiens
ctgtacatgcttttt

SEQ ID NO: 35798 - DNA, 15 bp, Homo sapiens
actgtacatgctttt

SEQ ID NO: 35799 - DNA, 15 bp, Homo sapiens
cactgtacatgcttt

SEQ ID NO: 35800 - DNA, 15 bp, Homo sapiens
acactgtacatgctt

SEQ ID NO: 35801 - DNA, 15 bp, Homo sapiens
aacactgtacatgct

SEQ ID NO: 35802 - DNA, 15 bp, Homo sapiens
gaacactgtacatgc

SEQ ID NO: 35803 - DNA, 15 bp, Homo sapiens
agaacactgtacatg

SEQ ID NO: 35804 - DNA, 15 bp, Homo sapiens
cagaacactgtacat

SEQ ID NO: 35805 - DNA, 15 bp, Homo sapiens
acagaacactgtaca

SEQ ID NO: 35806 - DNA, 15 bp, Homo sapiens
aacagaacactgtac

SEQ ID NO: 35807 - DNA, 15 bp, Homo sapiens
aaacagaacactgta

SEQ ID NO: 35808 - DNA, 15 bp, Homo sapiens
taaacagaacactgt

SEQ ID NO: 35809 - DNA, 15 bp, Homo sapiens
ttaaacagaacactg

SEQ ID NO: 35810 - DNA, 15 bp, Homo sapiens
attaaacagaacact

SEQ ID NO: 35811 - DNA, 15 bp, Homo sapiens
tattaaacagaacac

SEQ ID NO: 35812 - DNA, 15 bp, Homo sapiens
gtattaaacagaaca

SEQ ID NO: 35813 - DNA, 15 bp, Homo sapiens
agtattaaacagaac

SEQ ID NO: 35814 - DNA, 15 bp, Homo sapiens
gagtattaaacagaa

SEQ ID NO: 35815 - DNA, 15 bp, Homo sapiens
tgagtattaaacaga

SEQ ID NO: 35816 - DNA, 15 bp, Homo sapiens
atgagtattaaacag

SEQ ID NO: 35817 - DNA, 15 bp, Homo sapiens
gatgagtattaaaca

SEQ ID NO: 35818 - DNA, 15 bp, Homo sapiens
ggatgagtattaaac

SEQ ID NO: 35819 - DNA, 15 bp, Homo sapiens
aggatgagtattaaa

SEQ ID NO: 35820 - DNA, 15 bp, Homo sapiens
aaggatgagtattaa

SEQ ID NO: 35821 - DNA, 15 bp, Homo sapiens
caaggatgagtatta

SEQ ID NO: 35822 - DNA, 15 bp, Homo sapiens
acaaggatgagtatt

SEQ ID NO: 35823 - DNA, 15 bp, Homo sapiens
tacaaggatgagtat

SEQ ID NO: 35824 - DNA, 15 bp, Homo sapiens
atacaaggatgagta

SEQ ID NO: 35825 - DNA, 15 bp, Homo sapiens
tatacaaggatgagt

SEQ ID NO: 35826 - DNA, 15 bp, Homo sapiens
ttatacaaggatgag

SEQ ID NO: 35827 - DNA, 15 bp, Homo sapiens
tttatacaaggatga

SEQ ID NO: 35828 - DNA, 15 bp, Homo sapiens
ttttatacaaggatg

SEQ ID NO: 35829 - DNA, 15 bp, Homo sapiens
tttttatacaaggat

SEQ ID NO: 35830 - DNA, 15 bp, Homo sapiens
ttttttatacaagga

SEQ ID NO: 35831 - DNA, 15 bp, Homo sapiens
tttttttatacaagg

SEQ ID NO: 35832 - DNA, 15 bp, Homo sapiens
ttttttttatacaag

SEQ ID NO: 35833 - DNA, 15 bp, Homo sapiens
attttttttatacaa

SEQ ID NO: 35834 - DNA, 15 bp, Homo sapiens
tattttttttataca

SEQ ID NO: 35835 - DNA, 15 bp, Homo sapiens
ctattttttttatac

SEQ ID NO: 35836 - DNA, 15 bp, Homo sapiens
actattttttttata

SEQ ID NO: 35837 - DNA, 15 bp, Homo sapiens
aactattttttttat

SEQ ID NO: 35838 - DNA, 15 bp, Homo sapiens
caactatttttttta

SEQ ID NO: 35839 - DNA, 15 bp, Homo sapiens
tcaactatttttttt

SEQ ID NO: 35840 - DNA, 15 bp, Homo sapiens
ctcaactattttttt

SEQ ID NO: 35841 - DNA, 15 bp, Homo sapiens
gctcaactatttttt

SEQ ID NO: 35842 - DNA, 15 bp, Homo sapiens
ggctcaactattttt

SEQ ID NO: 35843 - DNA, 15 bp, Homo sapiens
tggctcaactatttt

SEQ ID NO: 35844 - DNA, 15 bp, Homo sapiens
ctggctcaactattt

SEQ ID NO: 35845 - DNA, 15 bp, Homo sapiens
gctggctcaactatt

SEQ ID NO: 35846 - DNA, 15 bp, Homo sapiens
tgctggctcaactat

SEQ ID NO: 35847 - DNA, 15 bp, Homo sapiens
ctgctggctcaacta

SEQ ID NO: 35848 - DNA, 15 bp, Homo sapiens
tctgctggctcaact

SEQ ID NO: 35849 - DNA, 15 bp, Homo sapiens
gtctgctggctcaac

SEQ ID NO: 35850 - DNA, 15 bp, Homo sapiens
tgtctgctggctcaa

SEQ ID NO: 35851 - DNA, 15 bp, Homo sapiens
atgtctgctggctca

SEQ ID NO: 35852 - DNA, 15 bp, Homo sapiens
aatgtctgctggctc

SEQ ID NO: 35853 - DNA, 15 bp, Homo sapiens
caatgtctgctggct

SEQ ID NO: 35854 - DNA, 15 bp, Homo sapiens
acaatgtctgctggc

SEQ ID NO: 35855 - DNA, 15 bp, Homo sapiens
gacaatgtctgctgg

SEQ ID NO: 35856 - DNA, 15 bp, Homo sapiens
tgacaatgtctgctg

SEQ ID NO: 35857 - DNA, 15 bp, Homo sapiens
ctgacaatgtctgct

SEQ ID NO: 35858 - DNA, 15 bp, Homo sapiens
gctgacaatgtctgc

SEQ ID NO: 35859 - DNA, 15 bp, Homo sapiens
tgctgacaatgtctg

SEQ ID NO: 35860 - DNA, 15 bp, Homo sapiens
ttgctgacaatgtct

SEQ ID NO: 35861 - DNA, 15 bp, Homo sapiens
tttgctgacaatgtc

SEQ ID NO: 35862 - DNA, 15 bp, Homo sapiens
atttgctgacaatgt

SEQ ID NO: 35863 - DNA, 15 bp, Homo sapiens
aatttgctgacaatg

SEQ ID NO: 35864 - DNA, 15 bp, Homo sapiens
taatttgctgacaat

SEQ ID NO: 35865 - DNA, 15 bp, Homo sapiens
ttaatttgctgacaa

SEQ ID NO: 35866 - DNA, 15 bp, Homo sapiens
attaatttgctgaca

SEQ ID NO: 35867 - DNA, 15 bp, Homo sapiens
aattaatttgctgac

SEQ ID NO: 35868 - DNA, 15 bp, Homo sapiens
caattaatttgctga

SEQ ID NO: 35869 - DNA, 15 bp, Homo sapiens
ccaattaatttgctg

SEQ ID NO: 35870 - DNA, 15 bp, Homo sapiens
gccaattaatttgct

SEQ ID NO: 35871 - DNA, 15 bp, Homo sapiens
tgccaattaatttgc

SEQ ID NO: 35872 - DNA, 15 bp, Homo sapiens
ctgccaattaatttg

SEQ ID NO: 35873 - DNA, 15 bp, Homo sapiens
gctgccaattaattt

SEQ ID NO: 35874 - DNA, 15 bp, Homo sapiens
tgctgccaattaatt

SEQ ID NO: 35875 - DNA, 15 bp, Homo sapiens
ctgctgccaattaat

SEQ ID NO: 35876 - DNA, 15 bp, Homo sapiens
tctgctgccaattaa

SEQ ID NO: 35877 - DNA, 15 bp, Homo sapiens
atctgctgccaatta

SEQ ID NO: 35878 - DNA, 15 bp, Homo sapiens
aatctgctgccaatt

SEQ ID NO: 35879 - DNA, 15 bp, Homo sapiens
aaatctgctgccaat

SEQ ID NO: 35880 - DNA, 15 bp, Homo sapiens
aaaatctgctgccaa

SEQ ID NO: 35881 - DNA, 15 bp, Homo sapiens
taaaatctgctgcca

SEQ ID NO: 35882 - DNA, 15 bp, Homo sapiens
ctaaaatctgctgcc

SEQ ID NO: 35883 - DNA, 15 bp, Homo sapiens
cctaaaatctgctgc

SEQ ID NO: 35884 - DNA, 15 bp, Homo sapiens
tcctaaaatctgctg

SEQ ID NO: 35885 - DNA, 15 bp, Homo sapiens
ttcctaaaatctgct

SEQ ID NO: 35886 - DNA, 15 bp, Homo sapiens
tttcctaaaatctgc

SEQ ID NO: 35887 - DNA, 15 bp, Homo sapiens
atttcctaaaatctg

SEQ ID NO: 35888 - DNA, 15 bp, Homo sapiens
catttcctaaaatct

SEQ ID NO: 35889 - DNA, 15 bp, Homo sapiens
tcatttcctaaaatc

SEQ ID NO: 35890 - DNA, 15 bp, Homo sapiens
ttcatttcctaaaat

SEQ ID NO: 35891 - DNA, 15 bp, Homo sapiens
attcatttcctaaaa

SEQ ID NO: 35892 - DNA, 15 bp, Homo sapiens
cattcatttcctaaa

SEQ ID NO: 35893 - DNA, 15 bp, Homo sapiens
acattcatttcctaa

SEQ ID NO: 35894 - DNA, 15 bp, Homo sapiens
cacattcatttccta

SEQ ID NO: 35895 - DNA, 15 bp, Homo sapiens
acacattcatttcct

SEQ ID NO: 35896 - DNA, 15 bp, Homo sapiens
cacacattcatttcc

SEQ ID NO: 35897 - DNA, 15 bp, Homo sapiens
acacacattcatttc

SEQ ID NO: 35898 - DNA, 15 bp, Homo sapiens
cacacacattcattt

SEQ ID NO: 35899 - DNA, 15 bp, Homo sapiens
ccacacacattcatt

SEQ ID NO: 35900 - DNA, 15 bp, Homo sapiens
accacacacattcat

SEQ ID NO: 35901 - DNA, 15 bp, Homo sapiens
aaccacacacattca

SEQ ID NO: 35902 - DNA, 15 bp, Homo sapiens
aaaccacacacattc

SEQ ID NO: 35903 - DNA, 15 bp, Homo sapiens
aaaaccacacacatt

SEQ ID NO: 35904 - DNA, 15 bp, Homo sapiens
aaaaaccacacacat

SEQ ID NO: 35905 - DNA, 15 bp, Homo sapiens
aaaaaaccacacaca

SEQ ID NO: 35906 - DNA, 15 bp, Homo sapiens
aaaaaaaccacacac

SEQ ID NO: 35907 - DNA, 15 bp, Homo sapiens
aaaaaaaaccacaca

SEQ ID NO: 35908 - DNA, 15 bp, Homo sapiens
gaaaaaaaaccacac

SEQ ID NO: 35909 - DNA, 15 bp, Homo sapiens
agaaaaaaaaccaca

SEQ ID NO: 35910 - DNA, 15 bp, Homo sapiens
tagaaaaaaaaccac

SEQ ID NO: 35911 - DNA, 15 bp, Homo sapiens
ttagaaaaaaaacca

SEQ ID NO: 35912 - DNA, 15 bp, Homo sapiens
tttagaaaaaaaacc

SEQ ID NO: 35913 - DNA, 15 bp, Homo sapiens
ttttagaaaaaaaac

SEQ ID NO: 35914 - DNA, 15 bp, Homo sapiens
gttttagaaaaaaaa

SEQ ID NO: 35915 - DNA, 15 bp, Homo sapiens
agttttagaaaaaaa

SEQ ID NO: 35916 - DNA, 15 bp, Homo sapiens
tagttttagaaaaaa

SEQ ID NO: 35917 - DNA, 15 bp, Homo sapiens
ttagttttagaaaaa

SEQ ID NO: 35918 - DNA, 15 bp, Homo sapiens
tttagttttagaaaa

SEQ ID NO: 35919 - DNA, 15 bp, Homo sapiens
atttagttttagaaa

SEQ ID NO: 35920 - DNA, 15 bp, Homo sapiens
tatttagttttagaa

SEQ ID NO: 35921 - DNA, 15 bp, Homo sapiens
ctatttagttttaga

SEQ ID NO: 35922 - DNA, 15 bp, Homo sapiens
gctatttagttttag

SEQ ID NO: 35923 - DNA, 15 bp, Homo sapiens
tgctatttagtttta

SEQ ID NO: 35924 - DNA, 15 bp, Homo sapiens
atgctatttagtttt

SEQ ID NO: 35925 - DNA, 15 bp, Homo sapiens
catgctatttagttt

SEQ ID NO: 35926 - DNA, 15 bp, Homo sapiens
acatgctatttagtt

SEQ ID NO: 35927 - DNA, 15 bp, Homo sapiens
tacatgctatttagt

SEQ ID NO: 35928 - DNA, 15 bp, Homo sapiens
atacatgctatttag

SEQ ID NO: 35929 - DNA, 15 bp, Homo sapiens
aatacatgctattta

SEQ ID NO: 35930 - DNA, 15 bp, Homo sapiens
caatacatgctattt

SEQ ID NO: 35931 - DNA, 15 bp, Homo sapiens
acaatacatgctatt

SEQ ID NO: 35932 - DNA, 15 bp, Homo sapiens
cacaatacatgctat

SEQ ID NO: 35933 - DNA, 15 bp, Homo sapiens
acacaatacatgcta

SEQ ID NO: 35934 - DNA, 15 bp, Homo sapiens
gacacaatacatgct

SEQ ID NO: 35935 - DNA, 15 bp, Homo sapiens
agacacaatacatgc

SEQ ID NO: 35936 - DNA, 15 bp, Homo sapiens
aagacacaatacatg

SEQ ID NO: 35937 - DNA, 15 bp, Homo sapiens
aaagacacaatacat

SEQ ID NO: 35938 - DNA, 15 bp, Homo sapiens
aaaagacacaataca

SEQ ID NO: 35939 - DNA, 15 bp, Homo sapiens
caaaagacacaatac

SEQ ID NO: 35940 - DNA, 15 bp, Homo sapiens
gcaaaagacacaata

SEQ ID NO: 35941 - DNA, 15 bp, Homo sapiens
tgcaaaagacacaat

SEQ ID NO: 35942 - DNA, 15 bp, Homo sapiens
atgcaaaagacacaa

SEQ ID NO: 35943 - DNA, 15 bp, Homo sapiens
catgcaaaagacaca

SEQ ID NO: 35944 - DNA, 15 bp, Homo sapiens
tcatgcaaaagacac

SEQ ID NO: 35945 - DNA, 15 bp, Homo sapiens
atcatgcaaaagaca

SEQ ID NO: 35946 - DNA, 15 bp, Homo sapiens
catcatgcaaaagac

SEQ ID NO: 35947 - DNA, 15 bp, Homo sapiens
tcatcatgcaaaaga

SEQ ID NO: 35948 - DNA, 15 bp, Homo sapiens
atcatcatgcaaaag

SEQ ID NO: 35949 - DNA, 15 bp, Homo sapiens
gatcatcatgcaaaa

SEQ ID NO: 35950 - DNA, 15 bp, Homo sapiens
ggatcatcatgcaaa

SEQ ID NO: 35951 - DNA, 15 bp, Homo sapiens
cggatcatcatgcaa

SEQ ID NO: 35952 - DNA, 15 bp, Homo sapiens
ccggatcatcatgca

SEQ ID NO: 35953 - DNA, 15 bp, Homo sapiens
tccggatcatcatgc

SEQ ID NO: 35954 - DNA, 15 bp, Homo sapiens
atccggatcatcatg

SEQ ID NO: 35955 - DNA, 15 bp, Homo sapiens
aatccggatcatcat

SEQ ID NO: 35956 - DNA, 15 bp, Homo sapiens
aaatccggatcatca

SEQ ID NO: 35957 - DNA, 15 bp, Homo sapiens
taaatccggatcatc

SEQ ID NO: 35958 - DNA, 15 bp, Homo sapiens
ttaaatccggatcat

SEQ ID NO: 35959 - DNA, 15 bp, Homo sapiens
attaaatccggatca

SEQ ID NO: 35960 - DNA, 15 bp, Homo sapiens
aattaaatccggatc

SEQ ID NO: 35961 - DNA, 15 bp, Homo sapiens
aaattaaatccggat

SEQ ID NO: 35962 - DNA, 15 bp, Homo sapiens
caaattaaatccgga

SEQ ID NO: 35963 - DNA, 15 bp, Homo sapiens
tcaaattaaatccgg

SEQ ID NO: 35964 - DNA, 15 bp, Homo sapiens
atcaaattaaatccg

SEQ ID NO: 35965 - DNA, 15 bp, Homo sapiens
tatcaaattaaatcc

SEQ ID NO: 35966 - DNA, 15 bp, Homo sapiens
atatcaaattaaatc

SEQ ID NO: 35967 - DNA, 15 bp, Homo sapiens
gatatcaaattaaat

SEQ ID NO: 35968 - DNA, 15 bp, Homo sapiens
tgatatcaaattaaa

SEQ ID NO: 35969 - DNA, 15 bp, Homo sapiens
gtgatatcaaattaa

SEQ ID NO: 35970 - DNA, 15 bp, Homo sapiens
tgtgatatcaaatta

SEQ ID NO: 35971 - DNA, 15 bp, Homo sapiens
ctgtgatatcaaatt

SEQ ID NO: 35972 - DNA, 15 bp, Homo sapiens
actgtgatatcaaat

SEQ ID NO: 35973 - DNA, 15 bp, Homo sapiens
gactgtgatatcaaa

SEQ ID NO: 35974 - DNA, 15 bp, Homo sapiens
agactgtgatatcaa

SEQ ID NO: 35975 - DNA, 15 bp, Homo sapiens
tagactgtgatatca

SEQ ID NO: 35976 - DNA, 15 bp, Homo sapiens
ttagactgtgatatc

SEQ ID NO: 35977 - DNA, 15 bp, Homo sapiens
attagactgtgatat

SEQ ID NO: 35978 - DNA, 15 bp, Homo sapiens
aattagactgtgata

SEQ ID NO: 35979 - DNA, 15 bp, Homo sapiens
aaattagactgtgat

SEQ ID NO: 35980 - DNA, 15 bp, Homo sapiens
aaaattagactgtga

SEQ ID NO: 35981 - DNA, 15 bp, Homo sapiens
aaaaattagactgtg

SEQ ID NO: 35982 - DNA, 15 bp, Homo sapiens
taaaaattagactgt

SEQ ID NO: 35983 - DNA, 15 bp, Homo sapiens
ataaaaattagactg

SEQ ID NO: 35984 - DNA, 15 bp, Homo sapiens
aataaaaattagact

SEQ ID NO: 35985 - DNA, 15 bp, Homo sapiens
gaataaaaattagac

SEQ ID NO: 35986 - DNA, 15 bp, Homo sapiens
tgaataaaaattaga

SEQ ID NO: 35987 - DNA, 15 bp, Homo sapiens
atgaataaaaattag

SEQ ID NO: 35988 - DNA, 15 bp, Homo sapiens
tatgaataaaaatta

SEQ ID NO: 35989 - DNA, 15 bp, Homo sapiens
ttatgaataaaaatt

SEQ ID NO: 35990 - DNA, 15 bp, Homo sapiens
cttatgaataaaaat

SEQ ID NO: 35991 - DNA, 15 bp, Homo sapiens
gcttatgaataaaaa

SEQ ID NO: 35992 - DNA, 15 bp, Homo sapiens
ggcttatgaataaaa

SEQ ID NO: 35993 - DNA, 15 bp, Homo sapiens
tggcttatgaataaa

SEQ ID NO: 35994 - DNA, 15 bp, Homo sapiens
ttggcttatgaataa

SEQ ID NO: 35995 - DNA, 15 bp, Homo sapiens
attggcttatgaata

SEQ ID NO: 35996 - DNA, 15 bp, Homo sapiens
aattggcttatgaat

SEQ ID NO: 35997 - DNA, 15 bp, Homo sapiens
aaattggcttatgaa

SEQ ID NO: 35998 - DNA, 15 bp, Homo sapiens
aaaattggcttatga

SEQ ID NO: 35999 - DNA, 15 bp, Homo sapiens
aaaaattggcttatg

SEQ ID NO: 36000 - DNA, 15 bp, Homo sapiens
gaaaaattggcttat

SEQ ID NO: 36001 - DNA, 15 bp, Homo sapiens
agaaaaattggctta

SEQ ID NO: 36002 - DNA, 15 bp, Homo sapiens
cagaaaaattggctt

SEQ ID NO: 36003 - DNA, 15 bp, Homo sapiens
gcagaaaaattggct

SEQ ID NO: 36004 - DNA, 15 bp, Homo sapiens
tgcagaaaaattggc

SEQ ID NO: 36005 - DNA, 15 bp, Homo sapiens
gtgcagaaaaattgg

SEQ ID NO: 36006 - DNA, 15 bp, Homo sapiens
agtgcagaaaaattg

SEQ ID NO: 36007 - DNA, 15 bp, Homo sapiens
cagtgcagaaaaatt

SEQ ID NO: 36008 - DNA, 15 bp, Homo sapiens
tcagtgcagaaaaat

SEQ ID NO: 36009 - DNA, 15 bp, Homo sapiens
ctcagtgcagaaaaa

SEQ ID NO: 36010 - DNA, 15 bp, Homo sapiens
gctcagtgcagaaaa

SEQ ID NO: 36011 - DNA, 15 bp, Homo sapiens
tgctcagtgcagaaa

SEQ ID NO: 36012 - DNA, 15 bp, Homo sapiens
ctgctcagtgcagaa

SEQ ID NO: 36013 - DNA, 15 bp, Homo sapiens
tctgctcagtgcaga

SEQ ID NO: 36014 - DNA, 15 bp, Homo sapiens
ctctgctcagtgcag

SEQ ID NO: 36015 - DNA, 15 bp, Homo sapiens
actctgctcagtgca

SEQ ID NO: 36016 - DNA, 15 bp, Homo sapiens
gactctgctcagtgc

SEQ ID NO: 36017 - DNA, 15 bp, Homo sapiens
agactctgctcagtg

SEQ ID NO: 36018 - DNA, 15 bp, Homo sapiens
aagactctgctcagt

SEQ ID NO: 36019 - DNA, 15 bp, Homo sapiens
caagactctgctcag

SEQ ID NO: 36020 - DNA, 15 bp, Homo sapiens
gcaagactctgctca

SEQ ID NO: 36021 - DNA, 15 bp, Homo sapiens
agcaagactctgctc

SEQ ID NO: 36022 - DNA, 15 bp, Homo sapiens
tagcaagactctgct

SEQ ID NO: 36023 - DNA, 15 bp, Homo sapiens
gtagcaagactctgc

SEQ ID NO: 36024 - DNA, 15 bp, Homo sapiens
ggtagcaagactctg

SEQ ID NO: 36025 - DNA, 15 bp, Homo sapiens
aggtagcaagactct

SEQ ID NO: 36026 - DNA, 15 bp, Homo sapiens
gaggtagcaagactc

SEQ ID NO: 36027 - DNA, 15 bp, Homo sapiens
tgaggtagcaagact

SEQ ID NO: 36028 - DNA, 15 bp, Homo sapiens
ctgaggtagcaagac

SEQ ID NO: 36029 - DNA, 15 bp, Homo sapiens
actgaggtagcaaga

SEQ ID NO: 36030 - DNA, 15 bp, Homo sapiens
gactgaggtagcaag

SEQ ID NO: 36031 - DNA, 15 bp, Homo sapiens
tgactgaggtagcaa

SEQ ID NO: 36032 - DNA, 15 bp, Homo sapiens
ctgactgaggtagca

SEQ ID NO: 36033 - DNA, 15 bp, Homo sapiens
actgactgaggtagc

SEQ ID NO: 36034 - DNA, 15 bp, Homo sapiens
tactgactgaggtag

SEQ ID NO: 36035 - DNA, 15 bp, Homo sapiens
atactgactgaggta

SEQ ID NO: 36036 - DNA, 15 bp, Homo sapiens
aatactgactgaggt

SEQ ID NO: 36037 - DNA, 15 bp, Homo sapiens
caatactgactgagg

SEQ ID NO: 36038 - DNA, 15 bp, Homo sapiens
acaatactgactgag

SEQ ID NO: 36039 - DNA, 15 bp, Homo sapiens
aacaatactgactga

SEQ ID NO: 36040 - DNA, 15 bp, Homo sapiens
aaacaatactgactg

SEQ ID NO: 36041 - DNA, 15 bp, Homo sapiens
aaaacaatactgact

SEQ ID NO: 36042 - DNA, 15 bp, Homo sapiens
caaaacaatactgac

SEQ ID NO: 36043 - DNA, 15 bp, Homo sapiens
ccaaaacaatactga

SEQ ID NO: 36044 - DNA, 15 bp, Homo sapiens
accaaaacaatactg

SEQ ID NO: 36045 - DNA, 15 bp, Homo sapiens
aaccaaaacaatact

SEQ ID NO: 36046 - DNA, 15 bp, Homo sapiens
aaaccaaaacaatac

SEQ ID NO: 36047 - DNA, 15 bp, Homo sapiens
caaaccaaaacaata

SEQ ID NO: 36048 - DNA, 15 bp, Homo sapiens
gcaaaccaaaacaat

SEQ ID NO: 36049 - DNA, 15 bp, Homo sapiens
agcaaaccaaaacaa

SEQ ID NO: 36050 - DNA, 15 bp, Homo sapiens
tagcaaaccaaaaca

SEQ ID NO: 36051 - DNA, 15 bp, Homo sapiens
gtagcaaaccaaaac

SEQ ID NO: 36052 - DNA, 15 bp, Homo sapiens
agtagcaaaccaaaa

SEQ ID NO: 36053 - DNA, 15 bp, Homo sapiens
aagtagcaaaccaaa

SEQ ID NO: 36054 - DNA, 15 bp, Homo sapiens
gaagtagcaaaccaa

SEQ ID NO: 36055 - DNA, 15 bp, Homo sapiens
ggaagtagcaaacca

SEQ ID NO: 36056 - DNA, 15 bp, Homo sapiens
gggaagtagcaaacc

SEQ ID NO: 36057 - DNA, 15 bp, Homo sapiens
agggaagtagcaaac

SEQ ID NO: 36058 - DNA, 15 bp, Homo sapiens
gagggaagtagcaaa

SEQ ID NO: 36059 - DNA, 15 bp, Homo sapiens
tgagggaagtagcaa

SEQ ID NO: 36060 - DNA, 15 bp, Homo sapiens
gtgagggaagtagca

SEQ ID NO: 36061 - DNA, 15 bp, Homo sapiens
ggtgagggaagtagc

SEQ ID NO: 36062 - DNA, 15 bp, Homo sapiens
gggtgagggaagtag

SEQ ID NO: 36063 - DNA, 15 bp, Homo sapiens
tgggtgagggaagta

SEQ ID NO: 36064 - DNA, 15 bp, Homo sapiens
gtgggtgagggaagt

SEQ ID NO: 36065 - DNA, 15 bp, Homo sapiens
agtgggtgagggaag

SEQ ID NO: 36066 - DNA, 15 bp, Homo sapiens
aagtgggtgagggaa

SEQ ID NO: 36067 - DNA, 15 bp, Homo sapiens
aaagtgggtgaggga

SEQ ID NO: 36068 - DNA, 15 bp, Homo sapiens
caaagtgggtgaggg

SEQ ID NO: 36069 - DNA, 15 bp, Homo sapiens
ccaaagtgggtgagg

SEQ ID NO: 36070 - DNA, 15 bp, Homo sapiens
gccaaagtgggtgag

SEQ ID NO: 36071 - DNA, 15 bp, Homo sapiens
ggccaaagtgggtga

SEQ ID NO: 36072 - DNA, 15 bp, Homo sapiens
aggccaaagtgggtg

SEQ ID NO: 36073 - DNA, 15 bp, Homo sapiens
gaggccaaagtgggt

SEQ ID NO: 36074 - DNA, 15 bp, Homo sapiens
ggaggccaaagtggg

SEQ ID NO: 36075 - DNA, 15 bp, Homo sapiens
cggaggccaaagtgg

SEQ ID NO: 36076 - DNA, 15 bp, Homo sapiens
acggaggccaaagtg

SEQ ID NO: 36077 - DNA, 15 bp, Homo sapiens
aacggaggccaaagt

SEQ ID NO: 36078 - DNA, 15 bp, Homo sapiens
gaacggaggccaaag

SEQ ID NO: 36079 - DNA, 15 bp, Homo sapiens
tgaacggaggccaaa

SEQ ID NO: 36080 - DNA, 15 bp, Homo sapiens
gtgaacggaggccaa

SEQ ID NO: 36081 - DNA, 15 bp, Homo sapiens
ggtgaacggaggcca

SEQ ID NO: 36082 - DNA, 15 bp, Homo sapiens
gggtgaacggaggcc

SEQ ID NO: 36083 - DNA, 15 bp, Homo sapiens
ggggtgaacggaggc

SEQ ID NO: 36084 - DNA, 15 bp, Homo sapiens
tggggtgaacggagg

SEQ ID NO: 36085 - DNA, 15 bp, Homo sapiens
gtggggtgaacggag

SEQ ID NO: 36086 - DNA, 15 bp, Homo sapiens
ggtggggtgaacgga

SEQ ID NO: 36087 - DNA, 15 bp, Homo sapiens
gggtggggtgaacgg

SEQ ID NO: 36088 - DNA, 15 bp, Homo sapiens
ggggtggggtgaacg

SEQ ID NO: 36089 - DNA, 15 bp, Homo sapiens
tggggtggggtgaac

SEQ ID NO: 36090 - DNA, 15 bp, Homo sapiens
gtggggtggggtgaa

SEQ ID NO: 36091 - DNA, 15 bp, Homo sapiens
ggtggggtggggtga

SEQ ID NO: 36092 - DNA, 15 bp, Homo sapiens
gggtggggtggggtg

SEQ ID NO: 36093 - DNA, 15 bp, Homo sapiens
ggggtggggtggggt

SEQ ID NO: 36094 - DNA, 15 bp, Homo sapiens
tggggtggggtgggg

SEQ ID NO: 36095 - DNA, 15 bp, Homo sapiens
gtggggtggggtggg

SEQ ID NO: 36096 - DNA, 15 bp, Homo sapiens
ggtggggtggggtgg

SEQ ID NO: 36097 - DNA, 15 bp, Homo sapiens
aggtggggtggggtg

SEQ ID NO: 36098 - DNA, 15 bp, Homo sapiens
gaggtggggtggggt

SEQ ID NO: 36099 - DNA, 15 bp, Homo sapiens
agaggtggggtgggg

SEQ ID NO: 36100 - DNA, 15 bp, Homo sapiens
gagaggtggggtggg

SEQ ID NO: 36101 - DNA, 15 bp, Homo sapiens
ggagaggtggggtgg

SEQ ID NO: 36102 - DNA, 15 bp, Homo sapiens
gggagaggtggggtg

SEQ ID NO: 36103 - DNA, 15 bp, Homo sapiens
ggggagaggtggggt

SEQ ID NO: 36104 - DNA, 15 bp, Homo sapiens
tggggagaggtgggg

SEQ ID NO: 36105 - DNA, 15 bp, Homo sapiens
gtggggagaggtggg

SEQ ID NO: 36106 - DNA, 15 bp, Homo sapiens
ggtggggagaggtgg

SEQ ID NO: 36107 - DNA, 15 bp, Homo sapiens
aggtggggagaggtg

SEQ ID NO: 36108 - DNA, 15 bp, Homo sapiens
aaggtggggagaggt

SEQ ID NO: 36109 - DNA, 15 bp, Homo sapiens
taaggtggggagagg

SEQ ID NO: 36110 - DNA, 15 bp, Homo sapiens
gtaaggtggggagag

SEQ ID NO: 36111 - DNA, 15 bp, Homo sapiens
ggtaaggtggggaga

SEQ ID NO: 36112 - DNA, 15 bp, Homo sapiens
gggtaaggtggggag

SEQ ID NO: 36113 - DNA, 15 bp, Homo sapiens
ggggtaaggtgggga

SEQ ID NO: 36114 - DNA, 15 bp, Homo sapiens
gggggtaaggtgggg

SEQ ID NO: 36115 - DNA, 15 bp, Homo sapiens
cgggggtaaggtggg

SEQ ID NO: 36116 - DNA, 15 bp, Homo sapiens
gcgggggtaaggtgg

SEQ ID NO: 36117 - DNA, 15 bp, Homo sapiens
ggcgggggtaaggtg

SEQ ID NO: 36118 - DNA, 15 bp, Homo sapiens
gggcgggggtaaggt

SEQ ID NO: 36119 - DNA, 15 bp, Homo sapiens
ggggcgggggtaagg

SEQ ID NO: 36120 - DNA, 15 bp, Homo sapiens
cggggcgggggtaag

SEQ ID NO: 36121 - DNA, 15 bp, Homo sapiens
gcggggcgggggtaa

SEQ ID NO: 36122 - DNA, 15 bp, Homo sapiens
agcggggcgggggta

SEQ ID NO: 36123 - DNA, 15 bp, Homo sapiens
aagcggggcgggggt

SEQ ID NO: 36124 - DNA, 15 bp, Homo sapiens
caagcggggcggggg

SEQ ID NO: 36125 - DNA, 15 bp, Homo sapiens
ccaagcggggcgggg

SEQ ID NO: 36126 - DNA, 15 bp, Homo sapiens
gccaagcggggcggg

SEQ ID NO: 36127 - DNA, 15 bp, Homo sapiens
agccaagcggggcgg

SEQ ID NO: 36128 - DNA, 15 bp, Homo sapiens
aagccaagcggggcg

SEQ ID NO: 36129 - DNA, 15 bp, Homo sapiens
gaagccaagcggggc

SEQ ID NO: 36130 - DNA, 15 bp, Homo sapiens
agaagccaagcgggg

SEQ ID NO: 36131 - DNA, 15 bp, Homo sapiens
aagaagccaagcggg

SEQ ID NO: 36132 - DNA, 15 bp, Homo sapiens
gaagaagccaagcgg

SEQ ID NO: 36133 - DNA, 15 bp, Homo sapiens
agaagaagccaagcg

SEQ ID NO: 36134 - DNA, 15 bp, Homo sapiens
aagaagaagccaagc

SEQ ID NO: 36135 - DNA, 15 bp, Homo sapiens
aaagaagaagccaag

SEQ ID NO: 36136 - DNA, 15 bp, Homo sapiens
taaagaagaagccaa

SEQ ID NO: 36137 - DNA, 15 bp, Homo sapiens
ctaaagaagaagcca

SEQ ID NO: 36138 - DNA, 15 bp, Homo sapiens
cctaaagaagaagcc

SEQ ID NO: 36139 - DNA, 15 bp, Homo sapiens
tcctaaagaagaagc

SEQ ID NO: 36140 - DNA, 15 bp, Homo sapiens
atcctaaagaagaag

SEQ ID NO: 36141 - DNA, 15 bp, Homo sapiens
aatcctaaagaagaa

SEQ ID NO: 36142 - DNA, 15 bp, Homo sapiens
caatcctaaagaaga

SEQ ID NO: 36143 - DNA, 15 bp, Homo sapiens
acaatcctaaagaag

SEQ ID NO: 36144 - DNA, 15 bp, Homo sapiens
cacaatcctaaagaa

SEQ ID NO: 36145 - DNA, 15 bp, Homo sapiens
tcacaatcctaaaga

SEQ ID NO: 36146 - DNA, 15 bp, Homo sapiens
atcacaatcctaaag

SEQ ID NO: 36147 - DNA, 15 bp, Homo sapiens
catcacaatcctaaa

SEQ ID NO: 36148 - DNA, 15 bp, Homo sapiens
ccatcacaatcctaa

SEQ ID NO: 36149 - DNA, 15 bp, Homo sapiens
accatcacaatccta

SEQ ID NO: 36150 - DNA, 15 bp, Homo sapiens
aaccatcacaatcct

SEQ ID NO: 36151 - DNA, 15 bp, Homo sapiens
gaaccatcacaatcc

SEQ ID NO: 36152 - DNA, 15 bp, Homo sapiens
cgaaccatcacaatc

SEQ ID NO: 36153 - DNA, 15 bp, Homo sapiens
acgaaccatcacaat

SEQ ID NO: 36154 - DNA, 15 bp, Homo sapiens
aacgaaccatcacaa

SEQ ID NO: 36155 - DNA, 15 bp, Homo sapiens
gaacgaaccatcaca

SEQ ID NO: 36156 - DNA, 15 bp, Homo sapiens
agaacgaaccatcac

SEQ ID NO: 36157 - DNA, 15 bp, Homo sapiens
cagaacgaaccatca

SEQ ID NO: 36158 - DNA, 15 bp, Homo sapiens
acagaacgaaccatc

SEQ ID NO: 36159 - DNA, 15 bp, Homo sapiens
aacagaacgaaccat

SEQ ID NO: 36160 - DNA, 15 bp, Homo sapiens
aaacagaacgaacca

SEQ ID NO: 36161 - DNA, 15 bp, Homo sapiens
taaacagaacgaacc

SEQ ID NO: 36162 - DNA, 15 bp, Homo sapiens
gtaaacagaacgaac

SEQ ID NO: 36163 - DNA, 15 bp, Homo sapiens
tgtaaacagaacgaa

SEQ ID NO: 36164 - DNA, 15 bp, Homo sapiens
atgtaaacagaacga

SEQ ID NO: 36165 - DNA, 15 bp, Homo sapiens
gatgtaaacagaacg

SEQ ID NO: 36166 - DNA, 15 bp, Homo sapiens
tgatgtaaacagaac

SEQ ID NO: 36167 - DNA, 15 bp, Homo sapiens
ctgatgtaaacagaa

SEQ ID NO: 36168 - DNA, 15 bp, Homo sapiens
actgatgtaaacaga

SEQ ID NO: 36169 - DNA, 15 bp, Homo sapiens
aactgatgtaaacag

SEQ ID NO: 36170 - DNA, 15 bp, Homo sapiens
aaactgatgtaaaca

SEQ ID NO: 36171 - DNA, 15 bp, Homo sapiens
aaaactgatgtaaac

SEQ ID NO: 36172 - DNA, 15 bp, Homo sapiens
taaaactgatgtaaa

SEQ ID NO: 36173 - DNA, 15 bp, Homo sapiens
ttaaaactgatgtaa

SEQ ID NO: 36174 - DNA, 15 bp, Homo sapiens
gttaaaactgatgta

SEQ ID NO: 36175 - DNA, 15 bp, Homo sapiens
cgttaaaactgatgt

SEQ ID NO: 36176 - DNA, 15 bp, Homo sapiens
tcgttaaaactgatg

SEQ ID NO: 36177 - DNA, 15 bp, Homo sapiens
ctcgttaaaactgat

SEQ ID NO: 36178 - DNA, 15 bp, Homo sapiens
tctcgttaaaactga

SEQ ID NO: 36179 - DNA, 15 bp, Homo sapiens
ctctcgttaaaactg

SEQ ID NO: 36180 - DNA, 15 bp, Homo sapiens
cctctcgttaaaact

SEQ ID NO: 36181 - DNA, 15 bp, Homo sapiens
acctctcgttaaaac

SEQ ID NO: 36182 - DNA, 15 bp, Homo sapiens
tacctctcgttaaaa

SEQ ID NO: 36183 - DNA, 15 bp, Homo sapiens
atacctctcgttaaa

SEQ ID NO: 36184 - DNA, 15 bp, Homo sapiens
catacctctcgttaa

SEQ ID NO: 36185 - DNA, 15 bp, Homo sapiens
gcatacctctcgtta

SEQ ID NO: 36186 - DNA, 15 bp, Homo sapiens
ggcatacctctcgtt

SEQ ID NO: 36187 - DNA, 15 bp, Homo sapiens
aggcatacctctcgt

SEQ ID NO: 36188 - DNA, 15 bp, Homo sapiens
caggcatacctctcg

SEQ ID NO: 36189 - DNA, 15 bp, Homo sapiens
acaggcatacctctc

SEQ ID NO: 36190 - DNA, 15 bp, Homo sapiens
tacaggcatacctct

SEQ ID NO: 36191 - DNA, 15 bp, Homo sapiens
gtacaggcatacctc

SEQ ID NO: 36192 - DNA, 15 bp, Homo sapiens
agtacaggcatacct

SEQ ID NO: 36193 - DNA, 15 bp, Homo sapiens
gagtacaggcatacc

SEQ ID NO: 36194 - DNA, 15 bp, Homo sapiens
cgagtacaggcatac

SEQ ID NO: 36195 - DNA, 15 bp, Homo sapiens
gcgagtacaggcata

SEQ ID NO: 36196 - DNA, 15 bp, Homo sapiens
agcgagtacaggcat

SEQ ID NO: 36197 - DNA, 15 bp, Homo sapiens
aagcgagtacaggca

SEQ ID NO: 36198 - DNA, 15 bp, Homo sapiens
caagcgagtacaggc

SEQ ID NO: 36199 - DNA, 15 bp, Homo sapiens
acaagcgagtacagg

SEQ ID NO: 36200 - DNA, 15 bp, Homo sapiens
cacaagcgagtacag

SEQ ID NO: 36201 - DNA, 15 bp, Homo sapiens
gcacaagcgagtaca

SEQ ID NO: 36202 - DNA, 15 bp, Homo sapiens
tgcacaagcgagtac

SEQ ID NO: 36203 - DNA, 15 bp, Homo sapiens
ctgcacaagcgagta

SEQ ID NO: 36204 - DNA, 15 bp, Homo sapiens
tctgcacaagcgagt

SEQ ID NO: 36205 - DNA, 15 bp, Homo sapiens
ttctgcacaagcgag

SEQ ID NO: 36206 - DNA, 15 bp, Homo sapiens
tttctgcacaagcga

SEQ ID NO: 36207 - DNA, 15 bp, Homo sapiens
ttttctgcacaagcg

SEQ ID NO: 36208 - DNA, 15 bp, Homo sapiens
gttttctgcacaagc

SEQ ID NO: 36209 - DNA, 15 bp, Homo sapiens
tgttttctgcacaag

SEQ ID NO: 36210 - DNA, 15 bp, Homo sapiens
atgttttctgcacaa

SEQ ID NO: 36211 - DNA, 15 bp, Homo sapiens
aatgttttctgcaca

SEQ ID NO: 36212 - DNA, 15 bp, Homo sapiens
caatgttttctgcac

SEQ ID NO: 36213 - DNA, 15 bp, Homo sapiens
acaatgttttctgca

SEQ ID NO: 36214 - DNA, 15 bp, Homo sapiens
aacaatgttttctgc

SEQ ID NO: 36215 - DNA, 15 bp, Homo sapiens
gaacaatgttttctg

SEQ ID NO: 36216 - DNA, 15 bp, Homo sapiens
ggaacaatgttttct

SEQ ID NO: 36217 - DNA, 15 bp, Homo sapiens
tggaacaatgttttc

SEQ ID NO: 36218 - DNA, 15 bp, Homo sapiens
ctggaacaatgtttt

SEQ ID NO: 36219 - DNA, 15 bp, Homo sapiens
tctggaacaatgttt

SEQ ID NO: 36220 - DNA, 15 bp, Homo sapiens
atctggaacaatgtt

SEQ ID NO: 36221 - DNA, 15 bp, Homo sapiens
aatctggaacaatgt

SEQ ID NO: 36222 - DNA, 15 bp, Homo sapiens
gaatctggaacaatg

SEQ ID NO: 36223 - DNA, 15 bp, Homo sapiens
tgaatctggaacaat

SEQ ID NO: 36224 - DNA, 15 bp, Homo sapiens
ttgaatctggaacaa

SEQ ID NO: 36225 - DNA, 15 bp, Homo sapiens
attgaatctggaaca

SEQ ID NO: 36226 - DNA, 15 bp, Homo sapiens
gattgaatctggaac

SEQ ID NO: 36227 - DNA, 15 bp, Homo sapiens
cgattgaatctggaa

SEQ ID NO: 36228 - DNA, 15 bp, Homo sapiens
tcgattgaatctgga

SEQ ID NO: 36229 - DNA, 15 bp, Homo sapiens
gtcgattgaatctgg

SEQ ID NO: 36230 - DNA, 15 bp, Homo sapiens
agtcgattgaatctg

SEQ ID NO: 36231 - DNA, 15 bp, Homo sapiens
cagtcgattgaatct

SEQ ID NO: 36232 - DNA, 15 bp, Homo sapiens
ccagtcgattgaatc

SEQ ID NO: 36233 - DNA, 15 bp, Homo sapiens
cccagtcgattgaat

SEQ ID NO: 36234 - DNA, 15 bp, Homo sapiens
acccagtcgattgaa

SEQ ID NO: 36235 - DNA, 15 bp, Homo sapiens
aacccagtcgattga

SEQ ID NO: 36236 - DNA, 15 bp, Homo sapiens
aaacccagtcgattg

SEQ ID NO: 36237 - DNA, 15 bp, Homo sapiens
taaacccagtcgatt

SEQ ID NO: 36238 - DNA, 15 bp, Homo sapiens
ataaacccagtcgat

SEQ ID NO: 36239 - DNA, 15 bp, Homo sapiens
cataaacccagtcga

SEQ ID NO: 36240 - DNA, 15 bp, Homo sapiens
acataaacccagtcg

SEQ ID NO: 36241 - DNA, 15 bp, Homo sapiens
gacataaacccagtc

SEQ ID NO: 36242 - DNA, 15 bp, Homo sapiens
ggacataaacccagt

SEQ ID NO: 36243 - DNA, 15 bp, Homo sapiens
gggacataaacccag

SEQ ID NO: 36244 - DNA, 15 bp, Homo sapiens
agggacataaaccca

SEQ ID NO: 36245 - DNA, 15 bp, Homo sapiens
aagggacataaaccc

SEQ ID NO: 36246 - DNA, 15 bp, Homo sapiens
gaagggacataaacc

SEQ ID NO: 36247 - DNA, 15 bp, Homo sapiens
tgaagggacataaac

SEQ ID NO: 36248 - DNA, 15 bp, Homo sapiens
gtgaagggacataaa

SEQ ID NO: 36249 - DNA, 15 bp, Homo sapiens
tgtgaagggacataa

SEQ ID NO: 36250 - DNA, 15 bp, Homo sapiens
atgtgaagggacata

SEQ ID NO: 36251 - DNA, 15 bp, Homo sapiens
tatgtgaagggacat

SEQ ID NO: 36252 - DNA, 15 bp, Homo sapiens
ctatgtgaagggaca

SEQ ID NO: 36253 - DNA, 15 bp, Homo sapiens
actatgtgaagggac

SEQ ID NO: 36254 - DNA, 15 bp, Homo sapiens
aactatgtgaaggga

SEQ ID NO: 36255 - DNA, 15 bp, Homo sapiens
aaactatgtgaaggg

SEQ ID NO: 36256 - DNA, 15 bp, Homo sapiens
aaaactatgtgaagg

SEQ ID NO: 36257 - DNA, 15 bp, Homo sapiens
aaaaactatgtgaag

SEQ ID NO: 36258 - DNA, 15 bp, Homo sapiens
taaaaactatgtgaa

SEQ ID NO: 36259 - DNA, 15 bp, Homo sapiens
ttaaaaactatgtga

SEQ ID NO: 36260 - DNA, 15 bp, Homo sapiens
cttaaaaactatgtg

SEQ ID NO: 36261 - DNA, 15 bp, Homo sapiens
ccttaaaaactatgt

SEQ ID NO: 36262 - DNA, 15 bp, Homo sapiens
accttaaaaactatg

SEQ ID NO: 36263 - DNA, 15 bp, Homo sapiens
aaccttaaaaactat

SEQ ID NO: 36264 - DNA, 15 bp, Homo sapiens
taaccttaaaaacta

SEQ ID NO: 36265 - DNA, 15 bp, Homo sapiens
ataaccttaaaaact

SEQ ID NO: 36266 - DNA, 15 bp, Homo sapiens
aataaccttaaaaac

SEQ ID NO: 36267 - DNA, 15 bp, Homo sapiens
aaataaccttaaaaa

SEQ ID NO: 36268 - DNA, 15 bp, Homo sapiens
taaataaccttaaaa

SEQ ID NO: 36269 - DNA, 15 bp, Homo sapiens
ataaataaccttaaa

SEQ ID NO: 36270 - DNA, 15 bp, Homo sapiens
aataaataaccttaa

SEQ ID NO: 36271 - DNA, 15 bp, Homo sapiens
aaataaataacctta

SEQ ID NO: 36272 - DNA, 15 bp, Homo sapiens
taaataaataacctt

SEQ ID NO: 36273 - DNA, 15 bp, Homo sapiens
ttaaataaataacct

SEQ ID NO: 36274 - DNA, 15 bp, Homo sapiens
tttaaataaataacc

SEQ ID NO: 36275 - DNA, 15 bp, Homo sapiens
atttaaataaataac

SEQ ID NO: 36276 - DNA, 15 bp, Homo sapiens
catttaaataaataa

SEQ ID NO: 36277 - DNA, 15 bp, Homo sapiens
acatttaaataaata

SEQ ID NO: 36278 - DNA, 15 bp, Homo sapiens
gacatttaaataaat

SEQ ID NO: 36279 - DNA, 15 bp, Homo sapiens
agacatttaaataaa

SEQ ID NO: 36280 - DNA, 15 bp, Homo sapiens
tagacatttaaataa

SEQ ID NO: 36281 - DNA, 15 bp, Homo sapiens
ttagacatttaaata

SEQ ID NO: 36282 - DNA, 15 bp, Homo sapiens
attagacatttaaat

SEQ ID NO: 36283 - DNA, 15 bp, Homo sapiens
cattagacatttaaa

SEQ ID NO: 36284 - DNA, 15 bp, Homo sapiens
acattagacatttaa

SEQ ID NO: 36285 - DNA, 15 bp, Homo sapiens
tacattagacattta

SEQ ID NO: 36286 - DNA, 15 bp, Homo sapiens
atacattagacattt

SEQ ID NO: 36287 - DNA, 15 bp, Homo sapiens
aatacattagacatt

SEQ ID NO: 36288 - DNA, 15 bp, Homo sapiens
aaatacattagacat

SEQ ID NO: 36289 - DNA, 15 bp, Homo sapiens
aaaatacattagaca

SEQ ID NO: 36290 - DNA, 15 bp, Homo sapiens
taaaatacattagac

SEQ ID NO: 36291 - DNA, 15 bp, Homo sapiens
ataaaatacattaga

SEQ ID NO: 36292 - DNA, 15 bp, Homo sapiens
aataaaatacattag

SEQ ID NO: 36293 - DNA, 15 bp, Homo sapiens
caataaaatacatta

SEQ ID NO: 36294 - DNA, 15 bp, Homo sapiens
acaataaaatacatt

SEQ ID NO: 36295 - DNA, 15 bp, Homo sapiens
tacaataaaatacat

SEQ ID NO: 36296 - DNA, 15 bp, Homo sapiens
ttacaataaaataca

SEQ ID NO: 36297 - DNA, 15 bp, Homo sapiens
gttacaataaaatac

SEQ ID NO: 36298 - DNA, 15 bp, Homo sapiens
tgttacaataaaata

SEQ ID NO: 36299 - DNA, 15 bp, Homo sapiens
ctgttacaataaaat

SEQ ID NO: 36300 - DNA, 15 bp, Homo sapiens
tctgttacaataaaa

SEQ ID NO: 36301 - DNA, 15 bp, Homo sapiens
gtctgttacaataaa

SEQ ID NO: 36302 - DNA, 15 bp, Homo sapiens
tgtctgttacaataa

SEQ ID NO: 36303 - DNA, 15 bp, Homo sapiens
atgtctgttacaata

SEQ ID NO: 36304 - DNA, 15 bp, Homo sapiens
aatgtctgttacaat

SEQ ID NO: 36305 - DNA, 15 bp, Homo sapiens
caatgtctgttacaa

SEQ ID NO: 36306 - DNA, 15 bp, Homo sapiens
acaatgtctgttaca

SEQ ID NO: 36307 - DNA, 15 bp, Homo sapiens
aacaatgtctgttac

SEQ ID NO: 36308 - DNA, 15 bp, Homo sapiens
aaacaatgtctgtta

SEQ ID NO: 36309 - DNA, 15 bp, Homo sapiens
aaaacaatgtctgtt

SEQ ID NO: 36310 - DNA, 15 bp, Homo sapiens
caaaacaatgtctgt

SEQ ID NO: 36311 - DNA, 15 bp, Homo sapiens
gcaaaacaatgtctg

SEQ ID NO: 36312 - DNA, 15 bp, Homo sapiens
ggcaaaacaatgtct

SEQ ID NO: 36313 - DNA, 15 bp, Homo sapiens
tggcaaaacaatgtc

SEQ ID NO: 36314 - DNA, 15 bp, Homo sapiens
ttggcaaaacaatgt

SEQ ID NO: 36315 - DNA, 15 bp, Homo sapiens
gttggcaaaacaatg

SEQ ID NO: 36316 - DNA, 15 bp, Homo sapiens
tgttggcaaaacaat

SEQ ID NO: 36317 - DNA, 15 bp, Homo sapiens
atgttggcaaaacaa

SEQ ID NO: 36318 - DNA, 15 bp, Homo sapiens
aatgttggcaaaaca

SEQ ID NO: 36319 - DNA, 15 bp, Homo sapiens
caatgttggcaaaac

SEQ ID NO: 36320 - DNA, 15 bp, Homo sapiens
gcaatgttggcaaaa

SEQ ID NO: 36321 - DNA, 15 bp, Homo sapiens
ggcaatgttggcaaa

SEQ ID NO: 36322 - DNA, 15 bp, Homo sapiens
aggcaatgttggcaa

SEQ ID NO: 36323 - DNA, 15 bp, Homo sapiens
taggcaatgttggca

SEQ ID NO: 36324 - DNA, 15 bp, Homo sapiens
ataggcaatgttggc

SEQ ID NO: 36325 - DNA, 15 bp, Homo sapiens
aataggcaatgttgg

SEQ ID NO: 36326 - DNA, 15 bp, Homo sapiens
aaataggcaatgttg

SEQ ID NO: 36327 - DNA, 15 bp, Homo sapiens
gaaataggcaatgtt

SEQ ID NO: 36328 - DNA, 15 bp, Homo sapiens
tgaaataggcaatgt

SEQ ID NO: 36329 - DNA, 15 bp, Homo sapiens
ctgaaataggcaatg

SEQ ID NO: 36330 - DNA, 15 bp, Homo sapiens
actgaaataggcaat

SEQ ID NO: 36331 - DNA, 15 bp, Homo sapiens
cactgaaataggcaa

SEQ ID NO: 36332 - DNA, 15 bp, Homo sapiens
ccactgaaataggca

SEQ ID NO: 36333 - DNA, 15 bp, Homo sapiens
gccactgaaataggc

SEQ ID NO: 36334 - DNA, 15 bp, Homo sapiens
tgccactgaaatagg

SEQ ID NO: 36335 - DNA, 15 bp, Homo sapiens
gtgccactgaaatag

SEQ ID NO: 36336 - DNA, 15 bp, Homo sapiens
cgtgccactgaaata

SEQ ID NO: 36337 - DNA, 15 bp, Homo sapiens
acgtgccactgaaat

SEQ ID NO: 36338 - DNA, 15 bp, Homo sapiens
gacgtgccactgaaa

SEQ ID NO: 36339 - DNA, 15 bp, Homo sapiens
tgacgtgccactgaa

SEQ ID NO: 36340 - DNA, 15 bp, Homo sapiens
atgacgtgccactga

SEQ ID NO: 36341 - DNA, 15 bp, Homo sapiens
gatgacgtgccactg

SEQ ID NO: 36342 - DNA, 15 bp, Homo sapiens
agatgacgtgccact

SEQ ID NO: 36343 - DNA, 15 bp, Homo sapiens
tagatgacgtgccac

SEQ ID NO: 36344 - DNA, 15 bp, Homo sapiens
ctagatgacgtgcca

SEQ ID NO: 36345 - DNA, 15 bp, Homo sapiens
actagatgacgtgcc

SEQ ID NO: 36346 - DNA, 15 bp, Homo sapiens
aactagatgacgtgc

SEQ ID NO: 36347 - DNA, 15 bp, Homo sapiens
aaactagatgacgtg

SEQ ID NO: 36348 - DNA, 15 bp, Homo sapiens
aaaactagatgacgt

SEQ ID NO: 36349 - DNA, 15 bp, Homo sapiens
taaaactagatgacg

SEQ ID NO: 36350 - DNA, 15 bp, Homo sapiens
ttaaaactagatgac

SEQ ID NO: 36351 - DNA, 15 bp, Homo sapiens
tttaaaactagatga

SEQ ID NO: 36352 - DNA, 15 bp, Homo sapiens
ttttaaaactagatg

SEQ ID NO: 36353 - DNA, 15 bp, Homo sapiens
tttttaaaactagat

SEQ ID NO: 36354 - DNA, 15 bp, Homo sapiens
ttttttaaaactaga

SEQ ID NO: 36355 - DNA, 15 bp, Homo sapiens
tttttttaaaactag

SEQ ID NO: 36356 - DNA, 15 bp, Homo sapiens
atttttttaaaacta

SEQ ID NO: 36357 - DNA, 15 bp, Homo sapiens
tatttttttaaaact

SEQ ID NO: 36358 - DNA, 15 bp, Homo sapiens
ttatttttttaaaac

SEQ ID NO: 36359 - DNA, 15 bp, Homo sapiens
tttatttttttaaaa

SEQ ID NO: 36360 - DNA, 15 bp, Homo sapiens
ttttatttttttaaa

SEQ ID NO: 36361 - DNA, 15 bp, Homo sapiens
gttttatttttttaa

SEQ ID NO: 36362 - DNA, 15 bp, Homo sapiens
tgttttattttttta

SEQ ID NO: 36363 - DNA, 15 bp, Homo sapiens
atgttttattttttt

SEQ ID NO: 36364 - DNA, 15 bp, Homo sapiens
aatgttttatttttt

SEQ ID NO: 36365 - DNA, 15 bp, Homo sapiens
aaatgttttattttt

SEQ ID NO: 36366 - DNA, 15 bp, Homo sapiens
aaaatgttttatttt

SEQ ID NO: 36367 - DNA, 15 bp, Homo sapiens
taaaatgttttattt

SEQ ID NO: 36368 - DNA, 15 bp, Homo sapiens
ttaaaatgttttatt

SEQ ID NO: 36369 - DNA, 15 bp, Homo sapiens
tttaaaatgttttat

SEQ ID NO: 36370 - DNA, 15 bp, Homo sapiens
atttaaaatgtttta

SEQ ID NO: 36371 - DNA, 15 bp, Homo sapiens
catttaaaatgtttt

SEQ ID NO: 36372 - DNA, 15 bp, Homo sapiens
ccatttaaaatgttt

SEQ ID NO: 36373 - DNA, 15 bp, Homo sapiens
tccatttaaaatgtt

SEQ ID NO: 36374 - DNA, 15 bp, Homo sapiens
gtccatttaaaatgt

SEQ ID NO: 36375 - DNA, 15 bp, Homo sapiens
tgtccatttaaaatg

SEQ ID NO: 36376 - DNA, 15 bp, Homo sapiens
ctgtccatttaaaat

SEQ ID NO: 36377 - DNA, 15 bp, Homo sapiens
tctgtccatttaaaa

SEQ ID NO: 36378 - DNA, 15 bp, Homo sapiens
ctctgtccatttaaa

SEQ ID NO: 36379 - DNA, 15 bp, Homo sapiens
tctctgtccatttaa

SEQ ID NO: 36380 - DNA, 15 bp, Homo sapiens
ttctctgtccattta

SEQ ID NO: 36381 - DNA, 15 bp, Homo sapiens
tttctctgtccattt

SEQ ID NO: 36382 - DNA, 15 bp, Homo sapiens
ttttctctgtccatt

SEQ ID NO: 36383 - DNA, 15 bp, Homo sapiens
tttttctctgtccat

SEQ ID NO: 36384 - DNA, 15 bp, Homo sapiens
atttttctctgtcca

SEQ ID NO: 36385 - DNA, 15 bp, Homo sapiens
tatttttctctgtcc

SEQ ID NO: 36386 - DNA, 15 bp, Homo sapiens
ttatttttctctgtc

SEQ ID NO: 36387 - DNA, 15 bp, Homo sapiens
gttatttttctctgt

SEQ ID NO: 36388 - DNA, 15 bp, Homo sapiens
agttatttttctctg

SEQ ID NO: 36389 - DNA, 15 bp, Homo sapiens
cagttatttttctct

SEQ ID NO: 36390 - DNA, 15 bp, Homo sapiens
acagttatttttctc

SEQ ID NO: 36391 - DNA, 15 bp, Homo sapiens
gacagttatttttct

SEQ ID NO: 36392 - DNA, 15 bp, Homo sapiens
agacagttatttttc

SEQ ID NO: 36393 - DNA, 15 bp, Homo sapiens
aagacagttattttt

SEQ ID NO: 36394 - DNA, 15 bp, Homo sapiens
caagacagttatttt

SEQ ID NO: 36395 - DNA, 15 bp, Homo sapiens
acaagacagttattt

SEQ ID NO: 36396 - DNA, 15 bp, Homo sapiens
gacaagacagttatt

SEQ ID NO: 36397 - DNA, 15 bp, Homo sapiens
agacaagacagttat

SEQ ID NO: 36398 - DNA, 15 bp, Homo sapiens
aagacaagacagtta

SEQ ID NO: 36399 - DNA, 15 bp, Homo sapiens
aaagacaagacagtt

SEQ ID NO: 36400 - DNA, 15 bp, Homo sapiens
taaagacaagacagt

SEQ ID NO: 36401 - DNA, 15 bp, Homo sapiens
ttaaagacaagacag

SEQ ID NO: 36402 - DNA, 15 bp, Homo sapiens
gttaaagacaagaca

SEQ ID NO: 36403 - DNA, 15 bp, Homo sapiens
agttaaagacaagac

SEQ ID NO: 36404 - DNA, 15 bp, Homo sapiens
gagttaaagacaaga

SEQ ID NO: 36405 - DNA, 15 bp, Homo sapiens
cgagttaaagacaag

SEQ ID NO: 36406 - DNA, 15 bp, Homo sapiens
acgagttaaagacaa

SEQ ID NO: 36407 - DNA, 15 bp, Homo sapiens
tacgagttaaagaca

SEQ ID NO: 36408 - DNA, 15 bp, Homo sapiens
ttacgagttaaagac

SEQ ID NO: 36409 - DNA, 15 bp, Homo sapiens
cttacgagttaaaga

SEQ ID NO: 36410 - DNA, 15 bp, Homo sapiens
acttacgagttaaag

SEQ ID NO: 36411 - DNA, 15 bp, Homo sapiens
cacttacgagttaaa

SEQ ID NO: 36412 - DNA, 15 bp, Homo sapiens
ccacttacgagttaa

SEQ ID NO: 36413 - DNA, 15 bp, Homo sapiens
gccacttacgagtta

SEQ ID NO: 36414 - DNA, 15 bp, Homo sapiens
agccacttacgagtt

SEQ ID NO: 36415 - DNA, 15 bp, Homo sapiens
aagccacttacgagt

SEQ ID NO: 36416 - DNA, 15 bp, Homo sapiens
taagccacttacgag

SEQ ID NO: 36417 - DNA, 15 bp, Homo sapiens
gtaagccacttacga

SEQ ID NO: 36418 - DNA, 15 bp, Homo sapiens
ggtaagccacttacg

SEQ ID NO: 36419 - DNA, 15 bp, Homo sapiens
aggtaagccacttac

SEQ ID NO: 36420 - DNA, 15 bp, Homo sapiens
caggtaagccactta

SEQ ID NO: 36421 - DNA, 15 bp, Homo sapiens
ccaggtaagccactt

SEQ ID NO: 36422 - DNA, 15 bp, Homo sapiens
cccaggtaagccact

SEQ ID NO: 36423 - DNA, 15 bp, Homo sapiens
tcccaggtaagccac

SEQ ID NO: 36424 - DNA, 15 bp, Homo sapiens
gtcccaggtaagcca

SEQ ID NO: 36425 - DNA, 15 bp, Homo sapiens
agtcccaggtaagcc

SEQ ID NO: 36426 - DNA, 15 bp, Homo sapiens
tagtcccaggtaagc

SEQ ID NO: 36427 - DNA, 15 bp, Homo sapiens
ttagtcccaggtaag

SEQ ID NO: 36428 - DNA, 15 bp, Homo sapiens
gttagtcccaggtaa

SEQ ID NO: 36429 - DNA, 15 bp, Homo sapiens
tgttagtcccaggta

SEQ ID NO: 36430 - DNA, 15 bp, Homo sapiens
ctgttagtcccaggt

SEQ ID NO: 36431 - DNA, 15 bp, Homo sapiens
tctgttagtcccagg

SEQ ID NO: 36432 - DNA, 15 bp, Homo sapiens
gtctgttagtcccag

SEQ ID NO: 36433 - DNA, 15 bp, Homo sapiens
tgtctgttagtccca

SEQ ID NO: 36434 - DNA, 15 bp, Homo sapiens
atgtctgttagtccc

SEQ ID NO: 36435 - DNA, 15 bp, Homo sapiens
catgtctgttagtcc

SEQ ID NO: 36436 - DNA, 15 bp, Homo sapiens
acatgtctgttagtc

SEQ ID NO: 36437 - DNA, 15 bp, Homo sapiens
gacatgtctgttagt

SEQ ID NO: 36438 - DNA, 15 bp, Homo sapiens
ggacatgtctgttag

SEQ ID NO: 36439 - DNA, 15 bp, Homo sapiens
tggacatgtctgtta

SEQ ID NO: 36440 - DNA, 15 bp, Homo sapiens
ttggacatgtctgtt

SEQ ID NO: 36441 - DNA, 15 bp, Homo sapiens
gttggacatgtctgt

SEQ ID NO: 36442 - DNA, 15 bp, Homo sapiens
agttggacatgtctg

SEQ ID NO: 36443 - DNA, 15 bp, Homo sapiens
aagttggacatgtct

SEQ ID NO: 36444 - DNA, 15 bp, Homo sapiens
aaagttggacatgtc

SEQ ID NO: 36445 - DNA, 15 bp, Homo sapiens
gaaagttggacatgt

SEQ ID NO: 36446 - DNA, 15 bp, Homo sapiens
agaaagttggacatg

SEQ ID NO: 36447 - DNA, 15 bp, Homo sapiens
gagaaagttggacat

SEQ ID NO: 36448 - DNA, 15 bp, Homo sapiens
agagaaagttggaca

SEQ ID NO: 36449 - DNA, 15 bp, Homo sapiens
gagagaaagttggac

SEQ ID NO: 36450 - DNA, 15 bp, Homo sapiens
ggagagaaagttgga

SEQ ID NO: 36451 - DNA, 15 bp, Homo sapiens
tggagagaaagttgg

SEQ ID NO: 36452 - DNA, 15 bp, Homo sapiens
ctggagagaaagttg

SEQ ID NO: 36453 - DNA, 15 bp, Homo sapiens
actggagagaaagtt

SEQ ID NO: 36454 - DNA, 15 bp, Homo sapiens
aactggagagaaagt

SEQ ID NO: 36455 - DNA, 15 bp, Homo sapiens
gaactggagagaaag

SEQ ID NO: 36456 - DNA, 15 bp, Homo sapiens
agaactggagagaaa

SEQ ID NO: 36457 - DNA, 15 bp, Homo sapiens
aagaactggagagaa

SEQ ID NO: 36458 - DNA, 15 bp, Homo sapiens
taagaactggagaga

SEQ ID NO: 36459 - DNA, 15 bp, Homo sapiens
ctaagaactggagag

SEQ ID NO: 36460 - DNA, 15 bp, Homo sapiens
gctaagaactggaga

SEQ ID NO: 36461 - DNA, 15 bp, Homo sapiens
agctaagaactggag

SEQ ID NO: 36462 - DNA, 15 bp, Homo sapiens
gagctaagaactgga

SEQ ID NO: 36463 - DNA, 15 bp, Homo sapiens
tgagctaagaactgg

SEQ ID NO: 36464 - DNA, 15 bp, Homo sapiens
ctgagctaagaactg

SEQ ID NO: 36465 - DNA, 15 bp, Homo sapiens
tctgagctaagaact

SEQ ID NO: 36466 - DNA, 15 bp, Homo sapiens
ttctgagctaagaac

SEQ ID NO: 36467 - DNA, 15 bp, Homo sapiens
gttctgagctaagaa

SEQ ID NO: 36468 - DNA, 15 bp, Homo sapiens
agttctgagctaaga

SEQ ID NO: 36469 - DNA, 15 bp, Homo sapiens
aagttctgagctaag

SEQ ID NO: 36470 - DNA, 15 bp, Homo sapiens
aaagttctgagctaa

SEQ ID NO: 36471 - DNA, 15 bp, Homo sapiens
taaagttctgagcta

SEQ ID NO: 36472 - DNA, 15 bp, Homo sapiens
ctaaagttctgagct

SEQ ID NO: 36473 - DNA, 15 bp, Homo sapiens
actaaagttctgagc

SEQ ID NO: 36474 - DNA, 15 bp, Homo sapiens
aactaaagttctgag

SEQ ID NO: 36475 - DNA, 15 bp, Homo sapiens
caactaaagttctga

SEQ ID NO: 36476 - DNA, 15 bp, Homo sapiens
acaactaaagttctg

SEQ ID NO: 36477 - DNA, 15 bp, Homo sapiens
tacaactaaagttct

SEQ ID NO: 36478 - DNA, 15 bp, Homo sapiens
gtacaactaaagttc

SEQ ID NO: 36479 - DNA, 15 bp, Homo sapiens
agtacaactaaagtt

SEQ ID NO: 36480 - DNA, 15 bp, Homo sapiens
gagtacaactaaagt

SEQ ID NO: 36481 - DNA, 15 bp, Homo sapiens
agagtacaactaaag

SEQ ID NO: 36482 - DNA, 15 bp, Homo sapiens
cagagtacaactaaa

SEQ ID NO: 36483 - DNA, 15 bp, Homo sapiens
gcagagtacaactaa

SEQ ID NO: 36484 - DNA, 15 bp, Homo sapiens
agcagagtacaacta

SEQ ID NO: 36485 - DNA, 15 bp, Homo sapiens
aagcagagtacaact

SEQ ID NO: 36486 - DNA, 15 bp, Homo sapiens
caagcagagtacaac

SEQ ID NO: 36487 - DNA, 15 bp, Homo sapiens
tcaagcagagtacaa

SEQ ID NO: 36488 - DNA, 15 bp, Homo sapiens
ctcaagcagagtaca

SEQ ID NO: 36489 - DNA, 15 bp, Homo sapiens
cctcaagcagagtac

SEQ ID NO: 36490 - DNA, 15 bp, Homo sapiens
ccctcaagcagagta

SEQ ID NO: 36491 - DNA, 15 bp, Homo sapiens
cccctcaagcagagt

SEQ ID NO: 36492 - DNA, 15 bp, Homo sapiens
tcccctcaagcagag

SEQ ID NO: 36493 - DNA, 15 bp, Homo sapiens
ttcccctcaagcaga

SEQ ID NO: 36494 - DNA, 15 bp, Homo sapiens
cttcccctcaagcag

SEQ ID NO: 36495 - DNA, 15 bp, Homo sapiens
tcttcccctcaagca

SEQ ID NO: 36496 - DNA, 15 bp, Homo sapiens
ttcttcccctcaagc

SEQ ID NO: 36497 - DNA, 15 bp, Homo sapiens
cttcttcccctcaag

SEQ ID NO: 36498 - DNA, 15 bp, Homo sapiens
ccttcttcccctcaa

SEQ ID NO: 36499 - DNA, 15 bp, Homo sapiens
gccttcttcccctca

SEQ ID NO: 36500 - DNA, 15 bp, Homo sapiens
agccttcttcccctc

SEQ ID NO: 36501 - DNA, 15 bp, Homo sapiens
gagccttcttcccct

SEQ ID NO: 36502 - DNA, 15 bp, Homo sapiens
ggagccttcttcccc

SEQ ID NO: 36503 - DNA, 15 bp, Homo sapiens
aggagccttcttccc

SEQ ID NO: 36504 - DNA, 15 bp, Homo sapiens
caggagccttcttcc

SEQ ID NO: 36505 - DNA, 15 bp, Homo sapiens
gcaggagccttcttc

SEQ ID NO: 36506 - DNA, 15 bp, Homo sapiens
agcaggagccttctt

SEQ ID NO: 36507 - DNA, 15 bp, Homo sapiens
gagcaggagccttct

SEQ ID NO: 36508 - DNA, 15 bp, Homo sapiens
agagcaggagccttc

SEQ ID NO: 36509 - DNA, 15 bp, Homo sapiens
cagagcaggagcctt

SEQ ID NO: 36510 - DNA, 15 bp, Homo sapiens
gcagagcaggagcct

SEQ ID NO: 36511 - DNA, 15 bp, Homo sapiens
agcagagcaggagcc

SEQ ID NO: 36512 - DNA, 15 bp, Homo sapiens
cagcagagcaggagc

SEQ ID NO: 36513 - DNA, 15 bp, Homo sapiens
acagcagagcaggag

SEQ ID NO: 36514 - DNA, 15 bp, Homo sapiens
cacagcagagcagga

SEQ ID NO: 36515 - DNA, 15 bp, Homo sapiens
acacagcagagcagg

SEQ ID NO: 36516 - DNA, 15 bp, Homo sapiens
tacacagcagagcag

SEQ ID NO: 36517 - DNA, 15 bp, Homo sapiens
ctacacagcagagca

SEQ ID NO: 36518 - DNA, 15 bp, Homo sapiens
cctacacagcagagc

SEQ ID NO: 36519 - DNA, 15 bp, Homo sapiens
acctacacagcagag

SEQ ID NO: 36520 - DNA, 15 bp, Homo sapiens
tacctacacagcaga

SEQ ID NO: 36521 - DNA, 15 bp, Homo sapiens
ctacctacacagcag

SEQ ID NO: 36522 - DNA, 15 bp, Homo sapiens
actacctacacagca

SEQ ID NO: 36523 - DNA, 15 bp, Homo sapiens
gactacctacacagc

SEQ ID NO: 36524 - DNA, 15 bp, Homo sapiens
tgactacctacacag

SEQ ID NO: 36525 - DNA, 15 bp, Homo sapiens
atgactacctacaca

SEQ ID NO: 36526 - DNA, 15 bp, Homo sapiens
tatgactacctacac

SEQ ID NO: 36527 - DNA, 15 bp, Homo sapiens
ctatgactacctaca

SEQ ID NO: 36528 - DNA, 15 bp, Homo sapiens
cctatgactacctac

SEQ ID NO: 36529 - DNA, 15 bp, Homo sapiens
tcctatgactaccta

SEQ ID NO: 36530 - DNA, 15 bp, Homo sapiens
ttcctatgactacct

SEQ ID NO: 36531 - DNA, 15 bp, Homo sapiens
attcctatgactacc

SEQ ID NO: 36532 - DNA, 15 bp, Homo sapiens
aattcctatgactac

SEQ ID NO: 36533 - DNA, 15 bp, Homo sapiens
caattcctatgacta

SEQ ID NO: 36534 - DNA, 15 bp, Homo sapiens
acaattcctatgact

SEQ ID NO: 36535 - DNA, 15 bp, Homo sapiens
tacaattcctatgac

SEQ ID NO: 36536 - DNA, 15 bp, Homo sapiens
atacaattcctatga

SEQ ID NO: 36537 - DNA, 15 bp, Homo sapiens
aatacaattcctatg

SEQ ID NO: 36538 - DNA, 15 bp, Homo sapiens
gaatacaattcctat

SEQ ID NO: 36539 - DNA, 15 bp, Homo sapiens
agaatacaattccta

SEQ ID NO: 36540 - DNA, 15 bp, Homo sapiens
aagaatacaattcct

SEQ ID NO: 36541 - DNA, 15 bp, Homo sapiens
taagaatacaattcc

SEQ ID NO: 36542 - DNA, 15 bp, Homo sapiens
ttaagaatacaattc

SEQ ID NO: 36543 - DNA, 15 bp, Homo sapiens
attaagaatacaatt

SEQ ID NO: 36544 - DNA, 15 bp, Homo sapiens
cattaagaatacaat

SEQ ID NO: 36545 - DNA, 15 bp, Homo sapiens
acattaagaatacaa

SEQ ID NO: 36546 - DNA, 15 bp, Homo sapiens
tacattaagaataca

SEQ ID NO: 36547 - DNA, 15 bp, Homo sapiens
gtacattaagaatac

SEQ ID NO: 36548 - DNA, 15 bp, Homo sapiens
tgtacattaagaata

SEQ ID NO: 36549 - DNA, 15 bp, Homo sapiens
ctgtacattaagaat

SEQ ID NO: 36550 - DNA, 15 bp, Homo sapiens
cctgtacattaagaa

SEQ ID NO: 36551 - DNA, 15 bp, Homo sapiens
gcctgtacattaaga

SEQ ID NO: 36552 - DNA, 15 bp, Homo sapiens
tgcctgtacattaag

SEQ ID NO: 36553 - DNA, 15 bp, Homo sapiens
gtgcctgtacattaa

SEQ ID NO: 36554 - DNA, 15 bp, Homo sapiens
agtgcctgtacatta

SEQ ID NO: 36555 - DNA, 15 bp, Homo sapiens
tagtgcctgtacatt

SEQ ID NO: 36556 - DNA, 15 bp, Homo sapiens
ttagtgcctgtacat

SEQ ID NO: 36557 - DNA, 15 bp, Homo sapiens
attagtgcctgtaca

SEQ ID NO: 36558 - DNA, 15 bp, Homo sapiens
aattagtgcctgtac

SEQ ID NO: 36559 - DNA, 15 bp, Homo sapiens
caattagtgcctgta

SEQ ID NO: 36560 - DNA, 15 bp, Homo sapiens
acaattagtgcctgt

SEQ ID NO: 36561 - DNA, 15 bp, Homo sapiens
gacaattagtgcctg

SEQ ID NO: 36562 - DNA, 15 bp, Homo sapiens
tgacaattagtgcct

SEQ ID NO: 36563 - DNA, 15 bp, Homo sapiens
atgacaattagtgcc

SEQ ID NO: 36564 - DNA, 15 bp, Homo sapiens
gatgacaattagtgc

SEQ ID NO: 36565 - DNA, 15 bp, Homo sapiens
agatgacaattagtg

SEQ ID NO: 36566 - DNA, 15 bp, Homo sapiens
cagatgacaattagt

SEQ ID NO: 36567 - DNA, 15 bp, Homo sapiens
acagatgacaattag

SEQ ID NO: 36568 - DNA, 15 bp, Homo sapiens
cacagatgacaatta

SEQ ID NO: 36569 - DNA, 15 bp, Homo sapiens
tcacagatgacaatt

SEQ ID NO: 36570 - DNA, 15 bp, Homo sapiens
atcacagatgacaat

SEQ ID NO: 36571 - DNA, 15 bp, Homo sapiens
catcacagatgacaa

SEQ ID NO: 36572 - DNA, 15 bp, Homo sapiens
acatcacagatgaca

SEQ ID NO: 36573 - DNA, 15 bp, Homo sapiens
tacatcacagatgac

SEQ ID NO: 36574 - DNA, 15 bp, Homo sapiens
gtacatcacagatga

SEQ ID NO: 36575 - DNA, 15 bp, Homo sapiens
tgtacatcacagatg

SEQ ID NO: 36576 - DNA, 15 bp, Homo sapiens
atgtacatcacagat

SEQ ID NO: 36577 - DNA, 15 bp, Homo sapiens
aatgtacatcacaga

SEQ ID NO: 36578 - DNA, 15 bp, Homo sapiens
aaatgtacatcacag

SEQ ID NO: 36579 - DNA, 15 bp, Homo sapiens
aaaatgtacatcaca

SEQ ID NO: 36580 - DNA, 15 bp, Homo sapiens
taaaatgtacatcac

SEQ ID NO: 36581 - DNA, 15 bp, Homo sapiens
ataaaatgtacatca

SEQ ID NO: 36582 - DNA, 15 bp, Homo sapiens
cataaaatgtacatc

SEQ ID NO: 36583 - DNA, 15 bp, Homo sapiens
gcataaaatgtacat

SEQ ID NO: 36584 - DNA, 15 bp, Homo sapiens
tgcataaaatgtaca

SEQ ID NO: 36585 - DNA, 15 bp, Homo sapiens
ttgcataaaatgtac

SEQ ID NO: 36586 - DNA, 15 bp, Homo sapiens
cttgcataaaatgta

SEQ ID NO: 36587 - DNA, 15 bp, Homo sapiens
acttgcataaaatgt

SEQ ID NO: 36588 - DNA, 15 bp, Homo sapiens
aacttgcataaaatg

SEQ ID NO: 36589 - DNA, 15 bp, Homo sapiens
aaacttgcataaaat

SEQ ID NO: 36590 - DNA, 15 bp, Homo sapiens
gaaacttgcataaaa

SEQ ID NO: 36591 - DNA, 15 bp, Homo sapiens
agaaacttgcataaa

SEQ ID NO: 36592 - DNA, 15 bp, Homo sapiens
cagaaacttgcataa

SEQ ID NO: 36593 - DNA, 15 bp, Homo sapiens
gcagaaacttgcata

SEQ ID NO: 36594 - DNA, 15 bp, Homo sapiens
agcagaaacttgcat

SEQ ID NO: 36595 - DNA, 15 bp, Homo sapiens
cagcagaaacttgca

SEQ ID NO: 36596 - DNA, 15 bp, Homo sapiens
ccagcagaaacttgc

SEQ ID NO: 36597 - DNA, 15 bp, Homo sapiens
gccagcagaaacttg

SEQ ID NO: 36598 - DNA, 15 bp, Homo sapiens
ggccagcagaaactt

SEQ ID NO: 36599 - DNA, 15 bp, Homo sapiens
aggccagcagaaact

SEQ ID NO: 36600 - DNA, 15 bp, Homo sapiens
caggccagcagaaac

SEQ ID NO: 36601 - DNA, 15 bp, Homo sapiens
ccaggccagcagaaa

SEQ ID NO: 36602 - DNA, 15 bp, Homo sapiens
accaggccagcagaa

SEQ ID NO: 36603 - DNA, 15 bp, Homo sapiens
taccaggccagcaga

SEQ ID NO: 36604 - DNA, 15 bp, Homo sapiens
ataccaggccagcag

SEQ ID NO: 36605 - DNA, 15 bp, Homo sapiens
tataccaggccagca

SEQ ID NO: 36606 - DNA, 15 bp, Homo sapiens
ctataccaggccagc

SEQ ID NO: 36607 - DNA, 15 bp, Homo sapiens
tctataccaggccag

SEQ ID NO: 36608 - DNA, 15 bp, Homo sapiens
ctctataccaggcca

SEQ ID NO: 36609 - DNA, 15 bp, Homo sapiens
tctctataccaggcc

SEQ ID NO: 36610 - DNA, 15 bp, Homo sapiens
ttctctataccaggc

SEQ ID NO: 36611 - DNA, 15 bp, Homo sapiens
gttctctataccagg

SEQ ID NO: 36612 - DNA, 15 bp, Homo sapiens
tgttctctataccag

SEQ ID NO: 36613 - DNA, 15 bp, Homo sapiens
atgttctctatacca

SEQ ID NO: 36614 - DNA, 15 bp, Homo sapiens
tatgttctctatacc

SEQ ID NO: 36615 - DNA, 15 bp, Homo sapiens
ttatgttctctatac

SEQ ID NO: 36616 - DNA, 15 bp, Homo sapiens
cttatgttctctata

SEQ ID NO: 36617 - DNA, 15 bp, Homo sapiens
ccttatgttctctat

SEQ ID NO: 36618 - DNA, 15 bp, Homo sapiens
cccttatgttctcta

SEQ ID NO: 36619 - DNA, 15 bp, Homo sapiens
gcccttatgttctct

SEQ ID NO: 36620 - DNA, 15 bp, Homo sapiens
tgcccttatgttctc

SEQ ID NO: 36621 - DNA, 15 bp, Homo sapiens
ttgcccttatgttct

SEQ ID NO: 36622 - DNA, 15 bp, Homo sapiens
cttgcccttatgttc

SEQ ID NO: 36623 - DNA, 15 bp, Homo sapiens
acttgcccttatgtt

SEQ ID NO: 36624 - DNA, 15 bp, Homo sapiens
cacttgcccttatgt

SEQ ID NO: 36625 - DNA, 15 bp, Homo sapiens
acacttgcccttatg

SEQ ID NO: 36626 - DNA, 15 bp, Homo sapiens
cacacttgcccttat

SEQ ID NO: 36627 - DNA, 15 bp, Homo sapiens
acacacttgccctta

SEQ ID NO: 36628 - DNA, 15 bp, Homo sapiens
tacacacttgccctt

SEQ ID NO: 36629 - DNA, 15 bp, Homo sapiens
atacacacttgccct

SEQ ID NO: 36630 - DNA, 15 bp, Homo sapiens
catacacacttgccc

SEQ ID NO: 36631 - DNA, 15 bp, Homo sapiens
acatacacacttgcc

SEQ ID NO: 36632 - DNA, 15 bp, Homo sapiens
cacatacacacttgc

SEQ ID NO: 36633 - DNA, 15 bp, Homo sapiens
acacatacacacttg

SEQ ID NO: 36634 - DNA, 15 bp, Homo sapiens
cacacatacacactt

SEQ ID NO: 36635 - DNA, 15 bp, Homo sapiens
acacacatacacact

SEQ ID NO: 36636 - DNA, 15 bp, Homo sapiens
cacacacatacacac

SEQ ID NO: 36637 - DNA, 15 bp, Homo sapiens
acacacacatacaca

SEQ ID NO: 36638 - DNA, 15 bp, Homo sapiens
tacacacacatacac

SEQ ID NO: 36639 - DNA, 15 bp, Homo sapiens
atacacacacataca

SEQ ID NO: 36640 - DNA, 15 bp, Homo sapiens
catacacacacatac

SEQ ID NO: 36641 - DNA, 15 bp, Homo sapiens
acatacacacacata

SEQ ID NO: 36642 - DNA, 15 bp, Homo sapiens
cacatacacacacat

SEQ ID NO: 36643 - DNA, 15 bp, Homo sapiens
acacatacacacaca

SEQ ID NO: 36644 - DNA, 15 bp, Homo sapiens
cacacatacacacac

SEQ ID NO: 36645 - DNA, 15 bp, Homo sapiens
acacacatacacaca

SEQ ID NO: 36646 - DNA, 15 bp, Homo sapiens
aaacacacacataca

SEQ ID NO: 36647 - DNA, 15 bp, Homo sapiens
aaaacacacacatac

SEQ ID NO: 36648 - DNA, 15 bp, Homo sapiens
caaaacacacacata

SEQ ID NO: 36649 - DNA, 15 bp, Homo sapiens
acaaaacacacacat

SEQ ID NO: 36650 - DNA, 15 bp, Homo sapiens
tacaaaacacacaca

SEQ ID NO: 36651 - DNA, 15 bp, Homo sapiens
ttacaaaacacacac

SEQ ID NO: 36652 - DNA, 15 bp, Homo sapiens
tttacaaaacacaca

SEQ ID NO: 36653 - DNA, 15 bp, Homo sapiens
ttttacaaaacacac

SEQ ID NO: 36654 - DNA, 15 bp, Homo sapiens
attttacaaaacaca

SEQ ID NO: 36655 - DNA, 15 bp, Homo sapiens
gattttacaaaacac

SEQ ID NO: 36656 - DNA, 15 bp, Homo sapiens
agattttacaaaaca

SEQ ID NO: 36657 - DNA, 15 bp, Homo sapiens
cagattttacaaaac

SEQ ID NO: 36658 - DNA, 15 bp, Homo sapiens
acagattttacaaaa

SEQ ID NO: 36659 - DNA, 15 bp, Homo sapiens
tacagattttacaaa

SEQ ID NO: 36660 - DNA, 15 bp, Homo sapiens
ttacagattttacaa

SEQ ID NO: 36661 - DNA, 15 bp, Homo sapiens
tttacagattttaca

SEQ ID NO: 36662 - DNA, 15 bp, Homo sapiens
atttacagattttac

SEQ ID NO: 36663 - DNA, 15 bp, Homo sapiens
tatttacagatttta

SEQ ID NO: 36664 - DNA, 15 bp, Homo sapiens
ctatttacagatttt

SEQ ID NO: 36665 - DNA, 15 bp, Homo sapiens
gctatttacagattt

SEQ ID NO: 36666 - DNA, 15 bp, Homo sapiens
tgctatttacagatt

SEQ ID NO: 36667 - DNA, 15 bp, Homo sapiens
gtgctatttacagat

SEQ ID NO: 36668 - DNA, 15 bp, Homo sapiens
tgtgctatttacaga

SEQ ID NO: 36669 - DNA, 15 bp, Homo sapiens
atgtgctatttacag

SEQ ID NO: 36670 - DNA, 15 bp, Homo sapiens
catgtgctatttaca

SEQ ID NO: 36671 - DNA, 15 bp, Homo sapiens
tcatgtgctatttac

SEQ ID NO: 36672 - DNA, 15 bp, Homo sapiens
gtcatgtgctattta

SEQ ID NO: 36673 - DNA, 15 bp, Homo sapiens
ggtcatgtgctattt

SEQ ID NO: 36674 - DNA, 15 bp, Homo sapiens
tggtcatgtgctatt

SEQ ID NO: 36675 - DNA, 15 bp, Homo sapiens
ttggtcatgtgctat

SEQ ID NO: 36676 - DNA, 15 bp, Homo sapiens
tttggtcatgtgcta

SEQ ID NO: 36677 - DNA, 15 bp, Homo sapiens
atttggtcatgtgct

SEQ ID NO: 36678 - DNA, 15 bp, Homo sapiens
catttggtcatgtgc

SEQ ID NO: 36679 - DNA, 15 bp, Homo sapiens
tcatttggtcatgtg

SEQ ID NO: 36680 - DNA, 15 bp, Homo sapiens
ttcatttggtcatgt

SEQ ID NO: 36681 - DNA, 15 bp, Homo sapiens
gttcatttggtcatg

SEQ ID NO: 36682 - DNA, 15 bp, Homo sapiens
tgttcatttggtcat

SEQ ID NO: 36683 - DNA, 15 bp, Homo sapiens
atgttcatttggtca

SEQ ID NO: 36684 - DNA, 15 bp, Homo sapiens
tatgttcatttggtc

SEQ ID NO: 36685 - DNA, 15 bp, Homo sapiens
atatgttcatttggt

SEQ ID NO: 36686 - DNA, 15 bp, Homo sapiens
aatatgttcatttgg

SEQ ID NO: 36687 - DNA, 15 bp, Homo sapiens
caatatgttcatttg

SEQ ID NO: 36688 - DNA, 15 bp, Homo sapiens
acaatatgttcattt

SEQ ID NO: 36689 - DNA, 15 bp, Homo sapiens
tacaatatgttcatt

SEQ ID NO: 36690 - DNA, 15 bp, Homo sapiens
atacaatatgttcat

SEQ ID NO: 36691 - DNA, 15 bp, Homo sapiens
tatacaatatgttca

SEQ ID NO: 36692 - DNA, 15 bp, Homo sapiens
ctatacaatatgttc

SEQ ID NO: 36693 - DNA, 15 bp, Homo sapiens
tctatacaatatgtt

SEQ ID NO: 36694 - DNA, 15 bp, Homo sapiens
ttctatacaatatgt

SEQ ID NO: 36695 - DNA, 15 bp, Homo sapiens
gttctatacaatatg

SEQ ID NO: 36696 - DNA, 15 bp, Homo sapiens
agttctatacaatat

SEQ ID NO: 36697 - DNA, 15 bp, Homo sapiens
tagttctatacaata

SEQ ID NO: 36698 - DNA, 15 bp, Homo sapiens
atagttctatacaat

SEQ ID NO: 36699 - DNA, 15 bp, Homo sapiens
aatagttctatacaa

SEQ ID NO: 36700 - DNA, 15 bp, Homo sapiens
aaatagttctataca

SEQ ID NO: 36701 - DNA, 15 bp, Homo sapiens
aaaatagttctatac

SEQ ID NO: 36702 - DNA, 15 bp, Homo sapiens
aaaaatagttctata

SEQ ID NO: 36703 - DNA, 15 bp, Homo sapiens
taaaaatagttctat

SEQ ID NO: 36704 - DNA, 15 bp, Homo sapiens
ataaaaatagttcta

SEQ ID NO: 36705 - DNA, 15 bp, Homo sapiens
aataaaaatagttct

SEQ ID NO: 36706 - DNA, 15 bp, Homo sapiens
aaataaaaatagttc

SEQ ID NO: 36707 - DNA, 15 bp, Homo sapiens
caaataaaaatagtt

SEQ ID NO: 36708 - DNA, 15 bp, Homo sapiens
tcaaataaaaatagt

SEQ ID NO: 36709 - DNA, 15 bp, Homo sapiens
ttcaaataaaaatag

SEQ ID NO: 36710 - DNA, 15 bp, Homo sapiens
attcaaataaaaata

SEQ ID NO: 36711 - DNA, 15 bp, Homo sapiens
cattcaaataaaaat

SEQ ID NO: 36712 - DNA, 15 bp, Homo sapiens
acattcaaataaaaa

SEQ ID NO: 36713 - DNA, 15 bp, Homo sapiens
cacattcaaataaaa

SEQ ID NO: 36714 - DNA, 15 bp, Homo sapiens
ccacattcaaataaa

SEQ ID NO: 36715 - DNA, 15 bp, Homo sapiens
gccacattcaaataa

SEQ ID NO: 36716 - DNA, 15 bp, Homo sapiens
tgccacattcaaata

SEQ ID NO: 36717 - DNA, 15 bp, Homo sapiens
gtgccacattcaaat

SEQ ID NO: 36718 - DNA, 15 bp, Homo sapiens
agtgccacattcaaa

SEQ ID NO: 36719 - DNA, 15 bp, Homo sapiens
tagtgccacattcaa

SEQ ID NO: 36720 - DNA, 15 bp, Homo sapiens
ttagtgccacattca

SEQ ID NO: 36721 - DNA, 15 bp, Homo sapiens
gttagtgccacattc

SEQ ID NO: 36722 - DNA, 15 bp, Homo sapiens
ggttagtgccacatt

SEQ ID NO: 36723 - DNA, 15 bp, Homo sapiens
tggttagtgccacat

SEQ ID NO: 36724 - DNA, 15 bp, Homo sapiens
gtggttagtgccaca

SEQ ID NO: 36725 - DNA, 15 bp, Homo sapiens
ggtggttagtgccac

SEQ ID NO: 36726 - DNA, 15 bp, Homo sapiens
tggtggttagtgcca

SEQ ID NO: 36727 - DNA, 15 bp, Homo sapiens
gtggtggttagtgcc

SEQ ID NO: 36728 - DNA, 15 bp, Homo sapiens
ggtggtggttagtgc

SEQ ID NO: 36729 - DNA, 15 bp, Homo sapiens
tggtggtggttagtg

SEQ ID NO: 36730 - DNA, 15 bp, Homo sapiens
gtggtggtggttagt

SEQ ID NO: 36731 - DNA, 15 bp, Homo sapiens
ggtggtggtggttag

SEQ ID NO: 36732 - DNA, 15 bp, Homo sapiens
cggtggtggtggtta

SEQ ID NO: 36733 - DNA, 15 bp, Homo sapiens
acggtggtggtggtt

SEQ ID NO: 36734 - DNA, 15 bp, Homo sapiens
aacggtggtggtggt

SEQ ID NO: 36735 - DNA, 15 bp, Homo sapiens
taacggtggtggtgg

SEQ ID NO: 36736 - DNA, 15 bp, Homo sapiens
gtaacggtggtggtg

SEQ ID NO: 36737 - DNA, 15 bp, Homo sapiens
agtaacggtggtggt

SEQ ID NO: 36738 - DNA, 15 bp, Homo sapiens
tagtaacggtggtgg

SEQ ID NO: 36739 - DNA, 15 bp, Homo sapiens
gtagtaacggtggtg

SEQ ID NO: 36740 - DNA, 15 bp, Homo sapiens
cgtagtaacggtggt

SEQ ID NO: 36741 - DNA, 15 bp, Homo sapiens
tcgtagtaacggtgg

SEQ ID NO: 36742 - DNA, 15 bp, Homo sapiens
atcgtagtaacggtg

SEQ ID NO: 36743 - DNA, 15 bp, Homo sapiens
gatcgtagtaacggt

SEQ ID NO: 36744 - DNA, 15 bp, Homo sapiens
tgatcgtagtaacgg

SEQ ID NO: 36745 - DNA, 15 bp, Homo sapiens
ttgatcgtagtaacg

SEQ ID NO: 36746 - DNA, 15 bp, Homo sapiens
attgatcgtagtaac

SEQ ID NO: 36747 - DNA, 15 bp, Homo sapiens
cattgatcgtagtaa

SEQ ID NO: 36748 - DNA, 15 bp, Homo sapiens
acattgatcgtagta

SEQ ID NO: 36749 - DNA, 15 bp, Homo sapiens
aacattgatcgtagt

SEQ ID NO: 36750 - DNA, 15 bp, Homo sapiens
aaacattgatcgtag

SEQ ID NO: 36751 - DNA, 15 bp, Homo sapiens
caaacattgatcgta

SEQ ID NO: 36752 - DNA, 15 bp, Homo sapiens
gcaaacattgatcgt

SEQ ID NO: 36753 - DNA, 15 bp, Homo sapiens
cgcaaacattgatcg

SEQ ID NO: 36754 - DNA, 15 bp, Homo sapiens
gcgcaaacattgatc

SEQ ID NO: 36755 - DNA, 15 bp, Homo sapiens
tgcgcaaacattgat

SEQ ID NO: 36756 - DNA, 15 bp, Homo sapiens
atgcgcaaacattga

SEQ ID NO: 36757 - DNA, 15 bp, Homo sapiens
catgcgcaaacattg

SEQ ID NO: 36758 - DNA, 15 bp, Homo sapiens
acatgcgcaaacatt

SEQ ID NO: 36759 - DNA, 15 bp, Homo sapiens
aacatgcgcaaacat

SEQ ID NO: 36760 - DNA, 15 bp, Homo sapiens
gaacatgcgcaaaca

SEQ ID NO: 36761 - DNA, 15 bp, Homo sapiens
cgaacatgcgcaaac

SEQ ID NO: 36762 - DNA, 15 bp, Homo sapiens
tcgaacatgcgcaaa

SEQ ID NO: 36763 - DNA, 15 bp, Homo sapiens
ctcgaacatgcgcaa

SEQ ID NO: 36764 - DNA, 15 bp, Homo sapiens
tctcgaacatgcgca

SEQ ID NO: 36765 - DNA, 15 bp, Homo sapiens
atctcgaacatgcgc

SEQ ID NO: 36766 - DNA, 15 bp, Homo sapiens
catctcgaacatgcg

SEQ ID NO: 36767 - DNA, 15 bp, Homo sapiens
tcatctcgaacatgc

SEQ ID NO: 36768 - DNA, 15 bp, Homo sapiens
ctcatctcgaacatg

SEQ ID NO: 36769 - DNA, 15 bp, Homo sapiens
actcatctcgaacat

SEQ ID NO: 36770 - DNA, 15 bp, Homo sapiens
gactcatctcgaaca

SEQ ID NO: 36771 - DNA, 15 bp, Homo sapiens
agactcatctcgaac

SEQ ID NO: 36772 - DNA, 15 bp, Homo sapiens
gagactcatctcgaa

SEQ ID NO: 36773 - DNA, 15 bp, Homo sapiens
tgagactcatctcga

SEQ ID NO: 36774 - DNA, 15 bp, Homo sapiens
gtgagactcatctcg

SEQ ID NO: 36775 - DNA, 15 bp, Homo sapiens
ggtgagactcatctc

SEQ ID NO: 36776 - DNA, 15 bp, Homo sapiens
tggtgagactcatct

SEQ ID NO: 36777 - DNA, 15 bp, Homo sapiens
ttggtgagactcatc

SEQ ID NO: 36778 - DNA, 15 bp, Homo sapiens
gttggtgagactcat

SEQ ID NO: 36779 - DNA, 15 bp, Homo sapiens
tgttggtgagactca

SEQ ID NO: 36780 - DNA, 15 bp, Homo sapiens
ctgttggtgagactc

SEQ ID NO: 36781 - DNA, 15 bp, Homo sapiens
actgttggtgagact

SEQ ID NO: 36782 - DNA, 15 bp, Homo sapiens
cactgttggtgagac

SEQ ID NO: 36783 - DNA, 15 bp, Homo sapiens
acactgttggtgaga

SEQ ID NO: 36784 - DNA, 15 bp, Homo sapiens
cacactgttggtgag

SEQ ID NO: 36785 - DNA, 15 bp, Homo sapiens
acacactgttggtga

SEQ ID NO: 36786 - DNA, 15 bp, Homo sapiens
tacacactgttggtg

SEQ ID NO: 36787 - DNA, 15 bp, Homo sapiens
ttacacactgttggt

SEQ ID NO: 36788 - DNA, 15 bp, Homo sapiens
cttacacactgttgg

SEQ ID NO: 36789 - DNA, 15 bp, Homo sapiens
acttacacactgttg

SEQ ID NO: 36790 - DNA, 15 bp, Homo sapiens
gacttacacactgtt

SEQ ID NO: 36791 - DNA, 15 bp, Homo sapiens
tgacttacacactgt

SEQ ID NO: 36792 - DNA, 15 bp, Homo sapiens
atgacttacacactg

SEQ ID NO: 36793 - DNA, 15 bp, Homo sapiens
aatgacttacacact

SEQ ID NO: 36794 - DNA, 15 bp, Homo sapiens
taatgacttacacac

SEQ ID NO: 36795 - DNA, 15 bp, Homo sapiens
ttaatgacttacaca

SEQ ID NO: 36796 - DNA, 15 bp, Homo sapiens
gttaatgacttacac

SEQ ID NO: 36797 - DNA, 15 bp, Homo sapiens
tgttaatgacttaca

SEQ ID NO: 36798 - DNA, 15 bp, Homo sapiens
ctgttaatgacttac

SEQ ID NO: 36799 - DNA, 15 bp, Homo sapiens
actgttaatgactta

SEQ ID NO: 36800 - DNA, 15 bp, Homo sapiens
gactgttaatgactt

SEQ ID NO: 36801 - DNA, 15 bp, Homo sapiens
ggactgttaatgact

SEQ ID NO: 36802 - DNA, 15 bp, Homo sapiens
aggactgttaatgac

SEQ ID NO: 36803 - DNA, 15 bp, Homo sapiens
taggactgttaatga

SEQ ID NO: 36804 - DNA, 15 bp, Homo sapiens
ttaggactgttaatg

SEQ ID NO: 36805 - DNA, 15 bp, Homo sapiens
gttaggactgttaat

SEQ ID NO: 36806 - DNA, 15 bp, Homo sapiens
agttaggactgttaa

SEQ ID NO: 36807 - DNA, 15 bp, Homo sapiens
cagttaggactgtta

SEQ ID NO: 36808 - DNA, 15 bp, Homo sapiens
acagttaggactgtt

SEQ ID NO: 36809 - DNA, 15 bp, Homo sapiens
cacagttaggactgt

SEQ ID NO: 36810 - DNA, 15 bp, Homo sapiens
ccacagttaggactg

SEQ ID NO: 36811 - DNA, 15 bp, Homo sapiens
accacagttaggact

SEQ ID NO: 36812 - DNA, 15 bp, Homo sapiens
caccacagttaggac

SEQ ID NO: 36813 - DNA, 15 bp, Homo sapiens
acaccacagttagga

SEQ ID NO: 36814 - DNA, 15 bp, Homo sapiens
aacaccacagttagg

SEQ ID NO: 36815 - DNA, 15 bp, Homo sapiens
aaacaccacagttag

SEQ ID NO: 36816 - DNA, 15 bp, Homo sapiens
aaaacaccacagtta

SEQ ID NO: 36817 - DNA, 15 bp, Homo sapiens
gaaaacaccacagtt

SEQ ID NO: 36818 - DNA, 15 bp, Homo sapiens
ggaaaacaccacagt

SEQ ID NO: 36819 - DNA, 15 bp, Homo sapiens
aggaaaacaccacag

SEQ ID NO: 36820 - DNA, 15 bp, Homo sapiens
gaggaaaacaccaca

SEQ ID NO: 36821 - DNA, 15 bp, Homo sapiens
ggaggaaaacaccac

SEQ ID NO: 36822 - DNA, 15 bp, Homo sapiens
tggaggaaaacacca

SEQ ID NO: 36823 - DNA, 15 bp, Homo sapiens
ttggaggaaaacacc

SEQ ID NO: 36824 - DNA, 15 bp, Homo sapiens
attggaggaaaacac

SEQ ID NO: 36825 - DNA, 15 bp, Homo sapiens
cattggaggaaaaca

SEQ ID NO: 36826 - DNA, 15 bp, Homo sapiens
gcattggaggaaaac

SEQ ID NO: 36827 - DNA, 15 bp, Homo sapiens
ggcattggaggaaaa

SEQ ID NO: 36828 - DNA, 15 bp, Homo sapiens
aggcattggaggaaa

SEQ ID NO: 36829 - DNA, 15 bp, Homo sapiens
aaggcattggaggaa

SEQ ID NO: 36830 - DNA, 15 bp, Homo sapiens
gaaggcattggagga

SEQ ID NO: 36831 - DNA, 15 bp, Homo sapiens
ggaaggcattggagg

SEQ ID NO: 36832 - DNA, 15 bp, Homo sapiens
tggaaggcattggag

SEQ ID NO: 36833 - DNA, 15 bp, Homo sapiens
ttggaaggcattgga

SEQ ID NO: 36834 - DNA, 15 bp, Homo sapiens
gttggaaggcattgg

SEQ ID NO: 36835 - DNA, 15 bp, Homo sapiens
tgttggaaggcattg

SEQ ID NO: 36836 - DNA, 15 bp, Homo sapiens
atgttggaaggcatt

SEQ ID NO: 36837 - DNA, 15 bp, Homo sapiens
gatgttggaaggcat

SEQ ID NO: 36838 - DNA, 15 bp, Homo sapiens
ggatgttggaaggca

SEQ ID NO: 36839 - DNA, 15 bp, Homo sapiens
tggatgttggaaggc

SEQ ID NO: 36840 - DNA, 15 bp, Homo sapiens
atggatgttggaagg

SEQ ID NO: 36841 - DNA, 15 bp, Homo sapiens
gatggatgttggaag

SEQ ID NO: 36842 - DNA, 15 bp, Homo sapiens
tgatggatgttggaa

SEQ ID NO: 36843 - DNA, 15 bp, Homo sapiens
ttgatggatgttgga

SEQ ID NO: 36844 - DNA, 15 bp, Homo sapiens
gttgatggatgttgg

SEQ ID NO: 36845 - DNA, 15 bp, Homo sapiens
agttgatggatgttg

SEQ ID NO: 36846 - DNA, 15 bp, Homo sapiens
tagttgatggatgtt

SEQ ID NO: 36847 - DNA, 15 bp, Homo sapiens
ttagttgatggatgt

SEQ ID NO: 36848 - DNA, 15 bp, Homo sapiens
gttagttgatggatg

SEQ ID NO: 36849 - DNA, 15 bp, Homo sapiens
cgttagttgatggat

SEQ ID NO: 36850 - DNA, 15 bp, Homo sapiens
acgttagttgatgga

SEQ ID NO: 36851 - DNA, 15 bp, Homo sapiens
cacgttagttgatgg

SEQ ID NO: 36852 - DNA, 15 bp, Homo sapiens
tcacgttagttgatg

SEQ ID NO: 36853 - DNA, 15 bp, Homo sapiens
ctcacgttagttgat

SEQ ID NO: 36854 - DNA, 15 bp, Homo sapiens
actcacgttagttga

SEQ ID NO: 36855 - DNA, 15 bp, Homo sapiens
tactcacgttagttg

SEQ ID NO: 36856 - DNA, 15 bp, Homo sapiens
atactcacgttagtt

SEQ ID NO: 36857 - DNA, 15 bp, Homo sapiens
aatactcacgttagt

SEQ ID NO: 36858 - DNA, 15 bp, Homo sapiens
aaatactcacgttag

SEQ ID NO: 36859 - DNA, 15 bp, Homo sapiens
aaaatactcacgtta

SEQ ID NO: 36860 - DNA, 15 bp, Homo sapiens
gaaaatactcacgtt

SEQ ID NO: 36861 - DNA, 15 bp, Homo sapiens
agaaaatactcacgt

SEQ ID NO: 36862 - DNA, 15 bp, Homo sapiens
aagaaaatactcacg

SEQ ID NO: 36863 - DNA, 15 bp, Homo sapiens
gaagaaaatactcac

SEQ ID NO: 36864 - DNA, 15 bp, Homo sapiens
ggaagaaaatactca

SEQ ID NO: 36865 - DNA, 15 bp, Homo sapiens
aggaagaaaatactc

SEQ ID NO: 36866 - DNA, 15 bp, Homo sapiens
caggaagaaaatact

SEQ ID NO: 36867 - DNA, 15 bp, Homo sapiens
ccaggaagaaaatac

SEQ ID NO: 36868 - DNA, 15 bp, Homo sapiens
cccaggaagaaaata

SEQ ID NO: 36869 - DNA, 15 bp, Homo sapiens
tcccaggaagaaaat

SEQ ID NO: 36870 - DNA, 15 bp, Homo sapiens
atcccaggaagaaaa

SEQ ID NO: 36871 - DNA, 15 bp, Homo sapiens
aatcccaggaagaaa

SEQ ID NO: 36872 - DNA, 15 bp, Homo sapiens
aaatcccaggaagaa

SEQ ID NO: 36873 - DNA, 15 bp, Homo sapiens
caaatcccaggaaga

SEQ ID NO: 36874 - DNA, 15 bp, Homo sapiens
ccaaatcccaggaag

SEQ ID NO: 36875 - DNA, 15 bp, Homo sapiens
tccaaatcccaggaa

SEQ ID NO: 36876 - DNA, 15 bp, Homo sapiens
atccaaatcccagga

SEQ ID NO: 36877 - DNA, 15 bp, Homo sapiens
catccaaatcccagg

SEQ ID NO: 36878 - DNA, 15 bp, Homo sapiens
gcatccaaatcccag

SEQ ID NO: 36879 - DNA, 15 bp, Homo sapiens
agcatccaaatccca

SEQ ID NO: 36880 - DNA, 15 bp, Homo sapiens
aagcatccaaatccc

SEQ ID NO: 36881 - DNA, 15 bp, Homo sapiens
aaagcatccaaatcc

SEQ ID NO: 36882 - DNA, 15 bp, Homo sapiens
taaagcatccaaatc

SEQ ID NO: 36883 - DNA, 15 bp, Homo sapiens
ctaaagcatccaaat

SEQ ID NO: 36884 - DNA, 15 bp, Homo sapiens
gctaaagcatccaaa

SEQ ID NO: 36885 - DNA, 15 bp, Homo sapiens
ggctaaagcatccaa

SEQ ID NO: 36886 - DNA, 15 bp, Homo sapiens
aggctaaagcatcca

SEQ ID NO: 36887 - DNA, 15 bp, Homo sapiens
taggctaaagcatcc

SEQ ID NO: 36888 - DNA, 15 bp, Homo sapiens
ttaggctaaagcatc

SEQ ID NO: 36889 - DNA, 15 bp, Homo sapiens
tttaggctaaagcat

SEQ ID NO: 36890 - DNA, 15 bp, Homo sapiens
ctttaggctaaagca

SEQ ID NO: 36891 - DNA, 15 bp, Homo sapiens
cctttaggctaaagc

SEQ ID NO: 36892 - DNA, 15 bp, Homo sapiens
acctttaggctaaag

SEQ ID NO: 36893 - DNA, 15 bp, Homo sapiens
cacctttaggctaaa

SEQ ID NO: 36894 - DNA, 15 bp, Homo sapiens
tcacctttaggctaa

SEQ ID NO: 36895 - DNA, 15 bp, Homo sapiens
gtcacctttaggcta

SEQ ID NO: 36896 - DNA, 15 bp, Homo sapiens
agtcacctttaggct

SEQ ID NO: 36897 - DNA, 15 bp, Homo sapiens
cagtcacctttaggc

SEQ ID NO: 36898 - DNA, 15 bp, Homo sapiens
gcagtcacctttagg

SEQ ID NO: 36899 - DNA, 15 bp, Homo sapiens
ggcagtcacctttag

SEQ ID NO: 36900 - DNA, 15 bp, Homo sapiens
tggcagtcaccttta

SEQ ID NO: 36901 - DNA, 15 bp, Homo sapiens
gtggcagtcaccttt

SEQ ID NO: 36902 - DNA, 15 bp, Homo sapiens
ggtggcagtcacctt

SEQ ID NO: 36903 - DNA, 15 bp, Homo sapiens
tggtggcagtcacct

SEQ ID NO: 36904 - DNA, 15 bp, Homo sapiens
ttggtggcagtcacc

SEQ ID NO: 36905 - DNA, 15 bp, Homo sapiens
cttggtggcagtcac

SEQ ID NO: 36906 - DNA, 15 bp, Homo sapiens
acttggtggcagtca

SEQ ID NO: 36907 - DNA, 15 bp, Homo sapiens
cacttggtggcagtc

SEQ ID NO: 36908 - DNA, 15 bp, Homo sapiens
tcacttggtggcagt

SEQ ID NO: 36909 - DNA, 15 bp, Homo sapiens
ctcacttggtggcag

SEQ ID NO: 36910 - DNA, 15 bp, Homo sapiens
tctcacttggtggca

SEQ ID NO: 36911 - DNA, 15 bp, Homo sapiens
atctcacttggtggc

SEQ ID NO: 36912 - DNA, 15 bp, Homo sapiens
tatctcacttggtgg

SEQ ID NO: 36913 - DNA, 15 bp, Homo sapiens
ttatctcacttggtg

SEQ ID NO: 36914 - DNA, 15 bp, Homo sapiens
gttatctcacttggt

SEQ ID NO: 36915 - DNA, 15 bp, Homo sapiens
agttatctcacttgg

SEQ ID NO: 36916 - DNA, 15 bp, Homo sapiens
cagttatctcacttg

SEQ ID NO: 36917 - DNA, 15 bp, Homo sapiens
acagttatctcactt

SEQ ID NO: 36918 - DNA, 15 bp, Homo sapiens
tacagttatctcact

SEQ ID NO: 36919 - DNA, 15 bp, Homo sapiens
atacagttatctcac

SEQ ID NO: 36920 - DNA, 15 bp, Homo sapiens
catacagttatctca

SEQ ID NO: 36921 - DNA, 15 bp, Homo sapiens
acatacagttatctc

SEQ ID NO: 36922 - DNA, 15 bp, Homo sapiens
gacatacagttatct

SEQ ID NO: 36923 - DNA, 15 bp, Homo sapiens
tgacatacagttatc

SEQ ID NO: 36924 - DNA, 15 bp, Homo sapiens
gtgacatacagttat

SEQ ID NO: 36925 - DNA, 15 bp, Homo sapiens
agtgacatacagtta

SEQ ID NO: 36926 - DNA, 15 bp, Homo sapiens
tagtgacatacagtt

SEQ ID NO: 36927 - DNA, 15 bp, Homo sapiens
ttagtgacatacagt

SEQ ID NO: 36928 - DNA, 15 bp, Homo sapiens
gttagtgacatacag

SEQ ID NO: 36929 - DNA, 15 bp, Homo sapiens
agttagtgacataca

SEQ ID NO: 36930 - DNA, 15 bp, Homo sapiens
aagttagtgacatac

SEQ ID NO: 36931 - DNA, 15 bp, Homo sapiens
taagttagtgacata

SEQ ID NO: 36932 - DNA, 15 bp, Homo sapiens
ataagttagtgacat

SEQ ID NO: 36933 - DNA, 15 bp, Homo sapiens
tataagttagtgaca

SEQ ID NO: 36934 - DNA, 15 bp, Homo sapiens
ttataagttagtgac

SEQ ID NO: 36935 - DNA, 15 bp, Homo sapiens
cttataagttagtga

SEQ ID NO: 36936 - DNA, 15 bp, Homo sapiens
gcttataagttagtg

SEQ ID NO: 36937 - DNA, 15 bp, Homo sapiens
ggcttataagttagt

SEQ ID NO: 36938 - DNA, 15 bp, Homo sapiens
cggcttataagttag

SEQ ID NO: 36939 - DNA, 15 bp, Homo sapiens
gcggcttataagtta

SEQ ID NO: 36940 - DNA, 15 bp, Homo sapiens
ggcggcttataagtt

SEQ ID NO: 36941 - DNA, 15 bp, Homo sapiens
aggcggcttataagt

SEQ ID NO: 36942 - DNA, 15 bp, Homo sapiens
gaggcggcttataag

SEQ ID NO: 36943 - DNA, 15 bp, Homo sapiens
ggaggcggcttataa

SEQ ID NO: 36944 - DNA, 15 bp, Homo sapiens
tggaggcggcttata

SEQ ID NO: 36945 - DNA, 15 bp, Homo sapiens
atggaggcggcttat

SEQ ID NO: 36946 - DNA, 15 bp, Homo sapiens
catggaggcggctta

SEQ ID NO: 36947 - DNA, 15 bp, Homo sapiens
ccatggaggcggctt

SEQ ID NO: 36948 - DNA, 15 bp, Homo sapiens
gccatggaggcggct

SEQ ID NO: 36949 - DNA, 15 bp, Homo sapiens
tgccatggaggcggc

SEQ ID NO: 36950 - DNA, 15 bp, Homo sapiens
ctgccatggaggcgg

SEQ ID NO: 36951 - DNA, 15 bp, Homo sapiens
tctgccatggaggcg

SEQ ID NO: 36952 - DNA, 15 bp, Homo sapiens
atctgccatggaggc

SEQ ID NO: 36953 - DNA, 15 bp, Homo sapiens
catctgccatggagg

SEQ ID NO: 36954 - DNA, 15 bp, Homo sapiens
gcatctgccatggag

SEQ ID NO: 36955 - DNA, 15 bp, Homo sapiens
agcatctgccatgga

SEQ ID NO: 36956 - DNA, 15 bp, Homo sapiens
cagcatctgccatgg

SEQ ID NO: 36957 - DNA, 15 bp, Homo sapiens
gcagcatctgccatg

SEQ ID NO: 36958 - DNA, 15 bp, Homo sapiens
agcagcatctgccat

SEQ ID NO: 36959 - DNA, 15 bp, Homo sapiens
cagcagcatctgcca

SEQ ID NO: 36960 - DNA, 15 bp, Homo sapiens
acagcagcatctgcc

SEQ ID NO: 36961 - DNA, 15 bp, Homo sapiens
cacagcagcatctgc

SEQ ID NO: 36962 - DNA, 15 bp, Homo sapiens
gcacagcagcatctg

SEQ ID NO: 36963 - DNA, 15 bp, Homo sapiens
agcacagcagcatct

SEQ ID NO: 36964 - DNA, 15 bp, Homo sapiens
gagcacagcagcatc

SEQ ID NO: 36965 - DNA, 15 bp, Homo sapiens
ggagcacagcagcat

SEQ ID NO: 36966 - DNA, 15 bp, Homo sapiens
gggagcacagcagca

SEQ ID NO: 36967 - DNA, 15 bp, Homo sapiens
agggagcacagcagc

SEQ ID NO: 36968 - DNA, 15 bp, Homo sapiens
cagggagcacagcag

SEQ ID NO: 36969 - DNA, 15 bp, Homo sapiens
tcagggagcacagca

SEQ ID NO: 36970 - DNA, 15 bp, Homo sapiens
atcagggagcacagc

SEQ ID NO: 36971 - DNA, 15 bp, Homo sapiens
catcagggagcacag

SEQ ID NO: 36972 - DNA, 15 bp, Homo sapiens
gcatcagggagcaca

SEQ ID NO: 36973 - DNA, 15 bp, Homo sapiens
ggcatcagggagcac

SEQ ID NO: 36974 - DNA, 15 bp, Homo sapiens
gggcatcagggagca

SEQ ID NO: 36975 - DNA, 15 bp, Homo sapiens
agggcatcagggagc

SEQ ID NO: 36976 - DNA, 15 bp, Homo sapiens
cagggcatcagggag

SEQ ID NO: 36977 - DNA, 15 bp, Homo sapiens
acagggcatcaggga

SEQ ID NO: 36978 - DNA, 15 bp, Homo sapiens
cacagggcatcaggg

SEQ ID NO: 36979 - DNA, 15 bp, Homo sapiens
tcacagggcatcagg

SEQ ID NO: 36980 - DNA, 15 bp, Homo sapiens
ctcacagggcatcag

SEQ ID NO: 36981 - DNA, 15 bp, Homo sapiens
gctcacagggcatca

SEQ ID NO: 36982 - DNA, 15 bp, Homo sapiens
tgctcacagggcatc

SEQ ID NO: 36983 - DNA, 15 bp, Homo sapiens
gtgctcacagggcat

SEQ ID NO: 36984 - DNA, 15 bp, Homo sapiens
ggtgctcacagggca

SEQ ID NO: 36985 - DNA, 15 bp, Homo sapiens
cggtgctcacagggc

SEQ ID NO: 36986 - DNA, 15 bp, Homo sapiens
ccggtgctcacaggg

SEQ ID NO: 36987 - DNA, 15 bp, Homo sapiens
cccggtgctcacagg

SEQ ID NO: 36988 - DNA, 15 bp, Homo sapiens
ccccggtgctcacag

SEQ ID NO: 36989 - DNA, 15 bp, Homo sapiens
accccggtgctcaca

SEQ ID NO: 36990 - DNA, 15 bp, Homo sapiens
aaccccggtgctcac

SEQ ID NO: 36991 - DNA, 15 bp, Homo sapiens
caaccccggtgctca

SEQ ID NO: 36992 - DNA, 15 bp, Homo sapiens
gcaaccccggtgctc

SEQ ID NO: 36993 - DNA, 15 bp, Homo sapiens
ggcaaccccggtgct

SEQ ID NO: 36994 - DNA, 15 bp, Homo sapiens
aggcaaccccggtgc

SEQ ID NO: 36995 - DNA, 15 bp, Homo sapiens
caggcaaccccggtg

SEQ ID NO: 36996 - DNA, 15 bp, Homo sapiens
acaggcaaccccggt

SEQ ID NO: 36997 - DNA, 15 bp, Homo sapiens
cacaggcaaccccgg

SEQ ID NO: 36998 - DNA, 15 bp, Homo sapiens
ccacaggcaaccccg

SEQ ID NO: 36999 - DNA, 15 bp, Homo sapiens
gccacaggcaacccc

SEQ ID NO: 37000 - DNA, 15 bp, Homo sapiens
cgccacaggcaaccc

SEQ ID NO: 37001 - DNA, 15 bp, Homo sapiens
gcgccacaggcaacc

SEQ ID NO: 37002 - DNA, 15 bp, Homo sapiens
ggcgccacaggcaac

SEQ ID NO: 37003 - DNA, 15 bp, Homo sapiens
aggcgccacaggcaa

SEQ ID NO: 37004 - DNA, 15 bp, Homo sapiens
caggcgccacaggca

SEQ ID NO: 37005 - DNA, 15 bp, Homo sapiens
gcaggcgccacaggc

SEQ ID NO: 37006 - DNA, 15 bp, Homo sapiens
ggcaggcgccacagg

SEQ ID NO: 37007 - DNA, 15 bp, Homo sapiens
tggcaggcgccacag

SEQ ID NO: 37008 - DNA, 15 bp, Homo sapiens
atggcaggcgccaca

SEQ ID NO: 37009 - DNA, 15 bp, Homo sapiens
catggcaggcgccac

SEQ ID NO: 37010 - DNA, 15 bp, Homo sapiens
acatggcaggcgcca

SEQ ID NO: 37011 - DNA, 15 bp, Homo sapiens
cacatggcaggcgcc

SEQ ID NO: 37012 - DNA, 15 bp, Homo sapiens
tcacatggcaggcgc

SEQ ID NO: 37013 - DNA, 15 bp, Homo sapiens
gtcacatggcaggcg

SEQ ID NO: 37014 - DNA, 15 bp, Homo sapiens
agtcacatggcaggc

SEQ ID NO: 37015 - DNA, 15 bp, Homo sapiens
gagtcacatggcagg

SEQ ID NO: 37016 - DNA, 15 bp, Homo sapiens
cgagtcacatggcag

SEQ ID NO: 37017 - DNA, 15 bp, Homo sapiens
ccgagtcacatggca

SEQ ID NO: 37018 - DNA, 15 bp, Homo sapiens
cccgagtcacatggc

SEQ ID NO: 37019 - DNA, 15 bp, Homo sapiens
gcccgagtcacatgg

SEQ ID NO: 37020 - DNA, 15 bp, Homo sapiens
cgcccgagtcacatg

SEQ ID NO: 37021 - DNA, 15 bp, Homo sapiens
gcgcccgagtcacat

SEQ ID NO: 37022 - DNA, 15 bp, Homo sapiens
tgcgcccgagtcaca

SEQ ID NO: 37023 - DNA, 15 bp, Homo sapiens
ctgcgcccgagtcac

SEQ ID NO: 37024 - DNA, 15 bp, Homo sapiens
gctgcgcccgagtca

SEQ ID NO: 37025 - DNA, 15 bp, Homo sapiens
tgctgcgcccgagtc

SEQ ID NO: 37026 - DNA, 15 bp, Homo sapiens
atgctgcgcccgagt

SEQ ID NO: 37027 - DNA, 15 bp, Homo sapiens
gatgctgcgcccgag

SEQ ID NO: 37028 - DNA, 15 bp, Homo sapiens
tgatgctgcgcccga

SEQ ID NO: 37029 - DNA, 15 bp, Homo sapiens
ctgatgctgcgcccg

SEQ ID NO: 37030 - DNA, 15 bp, Homo sapiens
gctgatgctgcgccc

SEQ ID NO: 37031 - DNA, 15 bp, Homo sapiens
agctgatgctgcgcc

SEQ ID NO: 37032 - DNA, 15 bp, Homo sapiens
cagctgatgctgcgc

SEQ ID NO: 37033 - DNA, 15 bp, Homo sapiens
ccagctgatgctgcg

SEQ ID NO: 37034 - DNA, 15 bp, Homo sapiens
gccagctgatgctgc

SEQ ID NO: 37035 - DNA, 15 bp, Homo sapiens
agccagctgatgctg

SEQ ID NO: 37036 - DNA, 15 bp, Homo sapiens
cagccagctgatgct

SEQ ID NO: 37037 - DNA, 15 bp, Homo sapiens
ccagccagctgatgc

SEQ ID NO: 37038 - DNA, 15 bp, Homo sapiens
tccagccagctgatg

SEQ ID NO: 37039 - DNA, 15 bp, Homo sapiens
ctccagccagctgat

SEQ ID NO: 37040 - DNA, 15 bp, Homo sapiens
cctccagccagctga

SEQ ID NO: 37041 - DNA, 15 bp, Homo sapiens
acctccagccagctg

SEQ ID NO: 37042 - DNA, 15 bp, Homo sapiens
cacctccagccagct

SEQ ID NO: 37043 - DNA, 15 bp, Homo sapiens
acacctccagccagc

SEQ ID NO: 37044 - DNA, 15 bp, Homo sapiens
cacacctccagccag

SEQ ID NO: 37045 - DNA, 15 bp, Homo sapiens
ccacacctccagcca

SEQ ID NO: 37046 - DNA, 15 bp, Homo sapiens
gccacacctccagcc

SEQ ID NO: 37047 - DNA, 15 bp, Homo sapiens
agccacacctccagc

SEQ ID NO: 37048 - DNA, 15 bp, Homo sapiens
aagccacacctccag

SEQ ID NO: 37049 - DNA, 15 bp, Homo sapiens
aaagccacacctcca

SEQ ID NO: 37050 - DNA, 15 bp, Homo sapiens
gaaagccacacctcc

SEQ ID NO: 37051 - DNA, 15 bp, Homo sapiens
tgaaagccacacctc

SEQ ID NO: 37052 - DNA, 15 bp, Homo sapiens
atgaaagccacacct

SEQ ID NO: 37053 - DNA, 15 bp, Homo sapiens
tatgaaagccacacc

SEQ ID NO: 37054 - DNA, 15 bp, Homo sapiens
ctatgaaagccacac

SEQ ID NO: 37055 - DNA, 15 bp, Homo sapiens
tctatgaaagccaca

SEQ ID NO: 37056 - DNA, 15 bp, Homo sapiens
gtctatgaaagccac

SEQ ID NO: 37057 - DNA, 15 bp, Homo sapiens
ggtctatgaaagcca

SEQ ID NO: 37058 - DNA, 15 bp, Homo sapiens
aggtctatgaaagcc

SEQ ID NO: 37059 - DNA, 15 bp, Homo sapiens
gaggtctatgaaagc

SEQ ID NO: 37060 - DNA, 15 bp, Homo sapiens
ggaggtctatgaaag

SEQ ID NO: 37061 - DNA, 15 bp, Homo sapiens
tggaggtctatgaaa

SEQ ID NO: 37062 - DNA, 15 bp, Homo sapiens
gtggaggtctatgaa

SEQ ID NO: 37063 - DNA, 15 bp, Homo sapiens
tgtggaggtctatga

SEQ ID NO: 37064 - DNA, 15 bp, Homo sapiens
ctgtggaggtctatg

SEQ ID NO: 37065 - DNA, 15 bp, Homo sapiens
cctgtggaggtctat

SEQ ID NO: 37066 - DNA, 15 bp, Homo sapiens
gcctgtggaggtcta

SEQ ID NO: 37067 - DNA, 15 bp, Homo sapiens
agcctgtggaggtct

SEQ ID NO: 37068 - DNA, 15 bp, Homo sapiens
cagcctgtggaggtc

SEQ ID NO: 37069 - DNA, 15 bp, Homo sapiens
gcagcctgtggaggt

SEQ ID NO: 37070 - DNA, 15 bp, Homo sapiens
ggcagcctgtggagg

SEQ ID NO: 37071 - DNA, 15 bp, Homo sapiens
aggcagcctgtggag

SEQ ID NO: 37072 - DNA, 15 bp, Homo sapiens
taggcagcctgtgga

SEQ ID NO: 37073 - DNA, 15 bp, Homo sapiens
ctaggcagcctgtgg

SEQ ID NO: 37074 - DNA, 15 bp, Homo sapiens
cctaggcagcctgtg

SEQ ID NO: 37075 - DNA, 15 bp, Homo sapiens
tcctaggcagcctgt

SEQ ID NO: 37076 - DNA, 15 bp, Homo sapiens
gtcctaggcagcctg

SEQ ID NO: 37077 - DNA, 15 bp, Homo sapiens
tgtcctaggcagcct

SEQ ID NO: 37078 - DNA, 15 bp, Homo sapiens
ttgtcctaggcagcc

SEQ ID NO: 37079 - DNA, 15 bp, Homo sapiens
cttgtcctaggcagc

SEQ ID NO: 37080 - DNA, 15 bp, Homo sapiens
tcttgtcctaggcag

SEQ ID NO: 37081 - DNA, 15 bp, Homo sapiens
atcttgtcctaggca

SEQ ID NO: 37082 - DNA, 15 bp, Homo sapiens
catcttgtcctaggc

SEQ ID NO: 37083 - DNA, 15 bp, Homo sapiens
tcatcttgtcctagg

SEQ ID NO: 37084 - DNA, 15 bp, Homo sapiens
gtcatcttgtcctag

SEQ ID NO: 37085 - DNA, 15 bp, Homo sapiens
ggtcatcttgtccta

SEQ ID NO: 37086 - DNA, 15 bp, Homo sapiens
tggtcatcttgtcct

SEQ ID NO: 37087 - DNA, 15 bp, Homo sapiens
ctggtcatcttgtcc

SEQ ID NO: 37088 - DNA, 15 bp, Homo sapiens
cctggtcatcttgtc

SEQ ID NO: 37089 - DNA, 15 bp, Homo sapiens
tcctggtcatcttgt

SEQ ID NO: 37090 - DNA, 15 bp, Homo sapiens
ctcctggtcatcttg

SEQ ID NO: 37091 - DNA, 15 bp, Homo sapiens
cctcctggtcatctt

SEQ ID NO: 37092 - DNA, 15 bp, Homo sapiens
ccctcctggtcatct

SEQ ID NO: 37093 - DNA, 15 bp, Homo sapiens
gccctcctggtcatc

SEQ ID NO: 37094 - DNA, 15 bp, Homo sapiens
ggccctcctggtcat

SEQ ID NO: 37095 - DNA, 15 bp, Homo sapiens
gggccctcctggtca

SEQ ID NO: 37096 - DNA, 15 bp, Homo sapiens
tgggccctcctggtc

SEQ ID NO: 37097 - DNA, 15 bp, Homo sapiens
ttgggccctcctggt

SEQ ID NO: 37098 - DNA, 15 bp, Homo sapiens
cttgggccctcctgg

SEQ ID NO: 37099 - DNA, 15 bp, Homo sapiens
gcttgggccctcctg

SEQ ID NO: 37100 - DNA, 15 bp, Homo sapiens
ggcttgggccctcct

SEQ ID NO: 37101 - DNA, 15 bp, Homo sapiens
tggcttgggccctcc

SEQ ID NO: 37102 - DNA, 15 bp, Homo sapiens
ctggcttgggccctc

SEQ ID NO: 37103 - DNA, 15 bp, Homo sapiens
tctggcttgggccct

SEQ ID NO: 37104 - DNA, 15 bp, Homo sapiens
gtctggcttgggccc

SEQ ID NO: 37105 - DNA, 15 bp, Homo sapiens
tgtctggcttgggcc

SEQ ID NO: 37106 - DNA, 15 bp, Homo sapiens
ttgtctggcttgggc

SEQ ID NO: 37107 - DNA, 15 bp, Homo sapiens
tttgtctggcttggg

SEQ ID NO: 37108 - DNA, 15 bp, Homo sapiens
ttttgtctggcttgg

SEQ ID NO: 37109 - DNA, 15 bp, Homo sapiens
cttttgtctggcttg

SEQ ID NO: 37110 - DNA, 15 bp, Homo sapiens
gcttttgtctggctt

SEQ ID NO: 37111 - DNA, 15 bp, Homo sapiens
ggcttttgtctggct

SEQ ID NO: 37112 - DNA, 15 bp, Homo sapiens
cggcttttgtctggc

SEQ ID NO: 37113 - DNA, 15 bp, Homo sapiens
ccggcttttgtctgg

SEQ ID NO: 37114 - DNA, 15 bp, Homo sapiens
tccggcttttgtctg

SEQ ID NO: 37115 - DNA, 15 bp, Homo sapiens
ctccggcttttgtct

SEQ ID NO: 37116 - DNA, 15 bp, Homo sapiens
actccggcttttgtc

SEQ ID NO: 37117 - DNA, 15 bp, Homo sapiens
cactccggcttttgt

SEQ ID NO: 37118 - DNA, 15 bp, Homo sapiens
ccactccggcttttg

SEQ ID NO: 37119 - DNA, 15 bp, Homo sapiens
cccactccggctttt

SEQ ID NO: 37120 - DNA, 15 bp, Homo sapiens
ccccactccggcttt

SEQ ID NO: 37121 - DNA, 15 bp, Homo sapiens
tccccactccggctt

SEQ ID NO: 37122 - DNA, 15 bp, Homo sapiens
ctccccactccggct

SEQ ID NO: 37123 - DNA, 15 bp, Homo sapiens
tctccccactccggc

SEQ ID NO: 37124 - DNA, 15 bp, Homo sapiens
ctctccccactccgg

SEQ ID NO: 37125 - DNA, 15 bp, Homo sapiens
tctctccccactccg

SEQ ID NO: 37126 - DNA, 15 bp, Homo sapiens
ctctctccccactcc

SEQ ID NO: 37127 - DNA, 15 bp, Homo sapiens
cctctctccccactc

SEQ ID NO: 37128 - DNA, 15 bp, Homo sapiens
gcctctctccccact

SEQ ID NO: 37129 - DNA, 15 bp, Homo sapiens
tgcctctctccccac

SEQ ID NO: 37130 - DNA, 15 bp, Homo sapiens
atgcctctctcccca

SEQ ID NO: 37131 - DNA, 15 bp, Homo sapiens
aatgcctctctcccc

SEQ ID NO: 37132 - DNA, 15 bp, Homo sapiens
aaatgcctctctccc

SEQ ID NO: 37133 - DNA, 15 bp, Homo sapiens
gaaatgcctctctcc

SEQ ID NO: 37134 - DNA, 15 bp, Homo sapiens
tgaaatgcctctctc

SEQ ID NO: 37135 - DNA, 15 bp, Homo sapiens
ctgaaatgcctctct

SEQ ID NO: 37136 - DNA, 15 bp, Homo sapiens
gctgaaatgcctctc

SEQ ID NO: 37137 - DNA, 15 bp, Homo sapiens
ggctgaaatgcctct

SEQ ID NO: 37138 - DNA, 15 bp, Homo sapiens
tggctgaaatgcctc

SEQ ID NO: 37139 - DNA, 15 bp, Homo sapiens
ctggctgaaatgcct

SEQ ID NO: 37140 - DNA, 15 bp, Homo sapiens
tctggctgaaatgcc

SEQ ID NO: 37141 - DNA, 15 bp, Homo sapiens
gtctggctgaaatgc

SEQ ID NO: 37142 - DNA, 15 bp, Homo sapiens
ggtctggctgaaatg

SEQ ID NO: 37143 - DNA, 15 bp, Homo sapiens
tggtctggctgaaat

SEQ ID NO: 37144 - DNA, 15 bp, Homo sapiens
ttggtctggctgaaa

SEQ ID NO: 37145 - DNA, 15 bp, Homo sapiens
gttggtctggctgaa

SEQ ID NO: 37146 - DNA, 15 bp, Homo sapiens
tgttggtctggctga

SEQ ID NO: 37147 - DNA, 15 bp, Homo sapiens
ctgttggtctggctg

SEQ ID NO: 37148 - DNA, 15 bp, Homo sapiens
cctgttggtctggct

SEQ ID NO: 37149 - DNA, 15 bp, Homo sapiens
gcctgttggtctggc

SEQ ID NO: 37150 - DNA, 15 bp, Homo sapiens
agcctgttggtctgg

SEQ ID NO: 37151 - DNA, 15 bp, Homo sapiens
cagcctgttggtctg

SEQ ID NO: 37152 - DNA, 15 bp, Homo sapiens
tcagcctgttggtct

SEQ ID NO: 37153 - DNA, 15 bp, Homo sapiens
ttcagcctgttggtc

SEQ ID NO: 37154 - DNA, 15 bp, Homo sapiens
cttcagcctgttggt

SEQ ID NO: 37155 - DNA, 15 bp, Homo sapiens
ccttcagcctgttgg

SEQ ID NO: 37156 - DNA, 15 bp, Homo sapiens
tccttcagcctgttg

SEQ ID NO: 37157 - DNA, 15 bp, Homo sapiens
ctccttcagcctgtt

SEQ ID NO: 37158 - DNA, 15 bp, Homo sapiens
gctccttcagcctgt

SEQ ID NO: 37159 - DNA, 15 bp, Homo sapiens
agctccttcagcctg

SEQ ID NO: 37160 - DNA, 15 bp, Homo sapiens
cagctccttcagcct

SEQ ID NO: 37161 - DNA, 15 bp, Homo sapiens
acagctccttcagcc

SEQ ID NO: 37162 - DNA, 15 bp, Homo sapiens
cacagctccttcagc

SEQ ID NO: 37163 - DNA, 15 bp, Homo sapiens
gcacagctccttcag

SEQ ID NO: 37164 - DNA, 15 bp, Homo sapiens
tgcacagctccttca

SEQ ID NO: 37165 - DNA, 15 bp, Homo sapiens
ctgcacagctccttc

SEQ ID NO: 37166 - DNA, 15 bp, Homo sapiens
tctgcacagctcctt

SEQ ID NO: 37167 - DNA, 15 bp, Homo sapiens
gtctgcacagctcct

SEQ ID NO: 37168 - DNA, 15 bp, Homo sapiens
agtctgcacagctcc

SEQ ID NO: 37169 - DNA, 15 bp, Homo sapiens
tagtctgcacagctc

SEQ ID NO: 37170 - DNA, 15 bp, Homo sapiens
atagtctgcacagct

SEQ ID NO: 37171 - DNA, 15 bp, Homo sapiens
aatagtctgcacagc

SEQ ID NO: 37172 - DNA, 15 bp, Homo sapiens
caatagtctgcacag

SEQ ID NO: 37173 - DNA, 15 bp, Homo sapiens
gcaatagtctgcaca

SEQ ID NO: 37174 - DNA, 15 bp, Homo sapiens
agcaatagtctgcac

SEQ ID NO: 37175 - DNA, 15 bp, Homo sapiens
tagcaatagtctgca

SEQ ID NO: 37176 - DNA, 15 bp, Homo sapiens
ttagcaatagtctgc

SEQ ID NO: 37177 - DNA, 15 bp, Homo sapiens
tttagcaatagtctg

SEQ ID NO: 37178 - DNA, 15 bp, Homo sapiens
ttttagcaatagtct

SEQ ID NO: 37179 - DNA, 15 bp, Homo sapiens
attttagcaatagtc

SEQ ID NO: 37180 - DNA, 15 bp, Homo sapiens
cattttagcaatagt

SEQ ID NO: 37181 - DNA, 15 bp, Homo sapiens
tcattttagcaatag

SEQ ID NO: 37182 - DNA, 15 bp, Homo sapiens
ctcattttagcaata

SEQ ID NO: 37183 - DNA, 15 bp, Homo sapiens
cctcattttagcaat

SEQ ID NO: 37184 - DNA, 15 bp, Homo sapiens
ccctcattttagcaa

SEQ ID NO: 37185 - DNA, 15 bp, Homo sapiens
accctcattttagca

SEQ ID NO: 37186 - DNA, 15 bp, Homo sapiens
aaccctcattttagc

SEQ ID NO: 37187 - DNA, 15 bp, Homo sapiens
gaaccctcattttag

SEQ ID NO: 37188 - DNA, 15 bp, Homo sapiens
cgaaccctcatttta

SEQ ID NO: 37189 - DNA, 15 bp, Homo sapiens
gcgaaccctcatttt

SEQ ID NO: 37190 - DNA, 15 bp, Homo sapiens
tgcgaaccctcattt

SEQ ID NO: 37191 - DNA, 15 bp, Homo sapiens
ctgcgaaccctcatt

SEQ ID NO: 37192 - DNA, 15 bp, Homo sapiens
gctgcgaaccctcat

SEQ ID NO: 37193 - DNA, 15 bp, Homo sapiens
agctgcgaaccctca

SEQ ID NO: 37194 - DNA, 15 bp, Homo sapiens
cagctgcgaaccctc

SEQ ID NO: 37195 - DNA, 15 bp, Homo sapiens
gcagctgcgaaccct

SEQ ID NO: 37196 - DNA, 15 bp, Homo sapiens
ggcagctgcgaaccc

SEQ ID NO: 37197 - DNA, 15 bp, Homo sapiens
tggcagctgcgaacc

SEQ ID NO: 37198 - DNA, 15 bp, Homo sapiens
ctggcagctgcgaac

SEQ ID NO: 37199 - DNA, 15 bp, Homo sapiens
cctggcagctgcgaa

SEQ ID NO: 37200 - DNA, 15 bp, Homo sapiens
tcctggcagctgcga

SEQ ID NO: 37201 - DNA, 15 bp, Homo sapiens
ctcctggcagctgcg

SEQ ID NO: 37202 - DNA, 15 bp, Homo sapiens
actcctggcagctgc

SEQ ID NO: 37203 - DNA, 15 bp, Homo sapiens
gactcctggcagctg

SEQ ID NO: 37204 - DNA, 15 bp, Homo sapiens
tgactcctggcagct

SEQ ID NO: 37205 - DNA, 15 bp, Homo sapiens
atgactcctggcagc

SEQ ID NO: 37206 - DNA, 15 bp, Homo sapiens
gatgactcctggcag

SEQ ID NO: 37207 - DNA, 15 bp, Homo sapiens
ggatgactcctggca

SEQ ID NO: 37208 - DNA, 15 bp, Homo sapiens
gggatgactcctggc

SEQ ID NO: 37209 - DNA, 15 bp, Homo sapiens
tgggatgactcctgg

SEQ ID NO: 37210 - DNA, 15 bp, Homo sapiens
ctgggatgactcctg

SEQ ID NO: 37211 - DNA, 15 bp, Homo sapiens
tctgggatgactcct

SEQ ID NO: 37212 - DNA, 15 bp, Homo sapiens
ttctgggatgactcc

SEQ ID NO: 37213 - DNA, 15 bp, Homo sapiens
gttctgggatgactc

SEQ ID NO: 37214 - DNA, 15 bp, Homo sapiens
tgttctgggatgact

SEQ ID NO: 37215 - DNA, 15 bp, Homo sapiens
atgttctgggatgac

SEQ ID NO: 37216 - DNA, 15 bp, Homo sapiens
aatgttctgggatga

SEQ ID NO: 37217 - DNA, 15 bp, Homo sapiens
caatgttctgggatg

SEQ ID NO: 37218 - DNA, 15 bp, Homo sapiens
gcaatgttctgggat

SEQ ID NO: 37219 - DNA, 15 bp, Homo sapiens
agcaatgttctggga

SEQ ID NO: 37220 - DNA, 15 bp, Homo sapiens
tagcaatgttctggg

SEQ ID NO: 37221 - DNA, 15 bp, Homo sapiens
gtagcaatgttctgg

SEQ ID NO: 37222 - DNA, 15 bp, Homo sapiens
agtagcaatgttctg

SEQ ID NO: 37223 - DNA, 15 bp, Homo sapiens
aagtagcaatgttct

SEQ ID NO: 37224 - DNA, 15 bp, Homo sapiens
taagtagcaatgttc

SEQ ID NO: 37225 - DNA, 15 bp, Homo sapiens
ataagtagcaatgtt

SEQ ID NO: 37226 - DNA, 15 bp, Homo sapiens
aataagtagcaatgt

SEQ ID NO: 37227 - DNA, 15 bp, Homo sapiens
aaataagtagcaatg

SEQ ID NO: 37228 - DNA, 15 bp, Homo sapiens
taaataagtagcaat

SEQ ID NO: 37229 - DNA, 15 bp, Homo sapiens
ataaataagtagcaa

SEQ ID NO: 37230 - DNA, 15 bp, Homo sapiens
aataaataagtagca

SEQ ID NO: 37231 - DNA, 15 bp, Homo sapiens
taataaataagtagc

SEQ ID NO: 37232 - DNA, 15 bp, Homo sapiens
ttaataaataagtag

SEQ ID NO: 37233 - DNA, 15 bp, Homo sapiens
tttaataaataagta

SEQ ID NO: 37234 - DNA, 15 bp, Homo sapiens
ttttaataaataagt

SEQ ID NO: 37235 - DNA, 15 bp, Homo sapiens
tttttaataaataag

SEQ ID NO: 37236 - DNA, 15 bp, Homo sapiens
ctttttaataaataa

SEQ ID NO: 37237 - DNA, 15 bp, Homo sapiens
gctttttaataaata

SEQ ID NO: 37238 - DNA, 15 bp, Homo sapiens
agctttttaataaat

SEQ ID NO: 37239 - DNA, 15 bp, Homo sapiens
tagctttttaataaa

SEQ ID NO: 37240 - DNA, 15 bp, Homo sapiens
ttagctttttaataa

SEQ ID NO: 37241 - DNA, 15 bp, Homo sapiens
tttagctttttaata

SEQ ID NO: 37242 - DNA, 15 bp, Homo sapiens
ttttagctttttaat

SEQ ID NO: 37243 - DNA, 15 bp, Homo sapiens
tttttagctttttaa

SEQ ID NO: 37244 - DNA, 15 bp, Homo sapiens
gtttttagcttttta

SEQ ID NO: 37245 - DNA, 15 bp, Homo sapiens
agtttttagcttttt

SEQ ID NO: 37246 - DNA, 15 bp, Homo sapiens
tagtttttagctttt

SEQ ID NO: 37247 - DNA, 15 bp, Homo sapiens
ctagtttttagcttt

SEQ ID NO: 37248 - DNA, 15 bp, Homo sapiens
actagtttttagctt

SEQ ID NO: 37249 - DNA, 15 bp, Homo sapiens
cactagtttttagct

SEQ ID NO: 37250 - DNA, 15 bp, Homo sapiens
tcactagtttttagc

SEQ ID NO: 37251 - DNA, 15 bp, Homo sapiens
ttcactagtttttag

SEQ ID NO: 37252 - DNA, 15 bp, Homo sapiens
tttcactagttttta

SEQ ID NO: 37253 - DNA, 15 bp, Homo sapiens
ctttcactagttttt

SEQ ID NO: 37254 - DNA, 15 bp, Homo sapiens
gctttcactagtttt

SEQ ID NO: 37255 - DNA, 15 bp, Homo sapiens
tgctttcactagttt

SEQ ID NO: 37256 - DNA, 15 bp, Homo sapiens
ttgctttcactagtt

SEQ ID NO: 37257 - DNA, 15 bp, Homo sapiens
cttgctttcactagt

SEQ ID NO: 37258 - DNA, 15 bp, Homo sapiens
acttgctttcactag

SEQ ID NO: 37259 - DNA, 15 bp, Homo sapiens
tacttgctttcacta

SEQ ID NO: 37260 - DNA, 15 bp, Homo sapiens
ttacttgctttcact

SEQ ID NO: 37261 - DNA, 15 bp, Homo sapiens
gttacttgctttcac

SEQ ID NO: 37262 - DNA, 15 bp, Homo sapiens
agttacttgctttca

SEQ ID NO: 37263 - DNA, 15 bp, Homo sapiens
cagttacttgctttc

SEQ ID NO: 37264 - DNA, 15 bp, Homo sapiens
tcagttacttgcttt

SEQ ID NO: 37265 - DNA, 15 bp, Homo sapiens
ttcagttacttgctt

SEQ ID NO: 37266 - DNA, 15 bp, Homo sapiens
gttcagttacttgct

SEQ ID NO: 37267 - DNA, 15 bp, Homo sapiens
ggttcagttacttgc

SEQ ID NO: 37268 - DNA, 15 bp, Homo sapiens
tggttcagttacttg

SEQ ID NO: 37269 - DNA, 15 bp, Homo sapiens
ctggttcagttactt

SEQ ID NO: 37270 - DNA, 15 bp, Homo sapiens
actggttcagttact

SEQ ID NO: 37271 - DNA, 15 bp, Homo sapiens
cactggttcagttac

SEQ ID NO: 37272 - DNA, 15 bp, Homo sapiens
tcactggttcagtta

SEQ ID NO: 37273 - DNA, 15 bp, Homo sapiens
ttcactggttcagtt

SEQ ID NO: 37274 - DNA, 15 bp, Homo sapiens
gttcactggttcagt

SEQ ID NO: 37275 - DNA, 15 bp, Homo sapiens
agttcactggttcag

SEQ ID NO: 37276 - DNA, 15 bp, Homo sapiens
gagttcactggttca

SEQ ID NO: 37277 - DNA, 15 bp, Homo sapiens
agagttcactggttc

SEQ ID NO: 37278 - DNA, 15 bp, Homo sapiens
cagagttcactggtt

SEQ ID NO: 37279 - DNA, 15 bp, Homo sapiens
ccagagttcactggt

SEQ ID NO: 37280 - DNA, 15 bp, Homo sapiens
cccagagttcactgg

SEQ ID NO: 37281 - DNA, 15 bp, Homo sapiens
acccagagttcactg

SEQ ID NO: 37282 - DNA, 15 bp, Homo sapiens
tacccagagttcact

SEQ ID NO: 37283 - DNA, 15 bp, Homo sapiens
atacccagagttcac

SEQ ID NO: 37284 - DNA, 15 bp, Homo sapiens
gatacccagagttca

SEQ ID NO: 37285 - DNA, 15 bp, Homo sapiens
cgatacccagagttc

SEQ ID NO: 37286 - DNA, 15 bp, Homo sapiens
tcgatacccagagtt

SEQ ID NO: 37287 - DNA, 15 bp, Homo sapiens
atcgatacccagagt

SEQ ID NO: 37288 - DNA, 15 bp, Homo sapiens
tatcgatacccagag

SEQ ID NO: 37289 - DNA, 15 bp, Homo sapiens
ctatcgatacccaga

SEQ ID NO: 37290 - DNA, 15 bp, Homo sapiens
cctatcgatacccag

SEQ ID NO: 37291 - DNA, 15 bp, Homo sapiens
acctatcgataccca

SEQ ID NO: 37292 - DNA, 15 bp, Homo sapiens
aacctatcgataccc

SEQ ID NO: 37293 - DNA, 15 bp, Homo sapiens
gaacctatcgatacc

SEQ ID NO: 37294 - DNA, 15 bp, Homo sapiens
cgaacctatcgatac

SEQ ID NO: 37295 - DNA, 15 bp, Homo sapiens
acgaacctatcgata

SEQ ID NO: 37296 - DNA, 15 bp, Homo sapiens
gacgaacctatcgat

SEQ ID NO: 37297 - DNA, 15 bp, Homo sapiens
agacgaacctatcga

SEQ ID NO: 37298 - DNA, 15 bp, Homo sapiens
aagacgaacctatcg

SEQ ID NO: 37299 - DNA, 15 bp, Homo sapiens
taagacgaacctatc

SEQ ID NO: 37300 - DNA, 15 bp, Homo sapiens
ttaagacgaacctat

SEQ ID NO: 37301 - DNA, 15 bp, Homo sapiens
tttaagacgaaccta

SEQ ID NO: 37302 - DNA, 15 bp, Homo sapiens
atttaagacgaacct

SEQ ID NO: 37303 - DNA, 15 bp, Homo sapiens
tatttaagacgaacc

SEQ ID NO: 37304 - DNA, 15 bp, Homo sapiens
ctatttaagacgaac

SEQ ID NO: 37305 - DNA, 15 bp, Homo sapiens
cctatttaagacgaa

SEQ ID NO: 37306 - DNA, 15 bp, Homo sapiens
gcctatttaagacga

SEQ ID NO: 37307 - DNA, 15 bp, Homo sapiens
ggcctatttaagacg

SEQ ID NO: 37308 - DNA, 15 bp, Homo sapiens
tggcctatttaagac

SEQ ID NO: 37309 - DNA, 15 bp, Homo sapiens
gtggcctatttaaga

SEQ ID NO: 37310 - DNA, 15 bp, Homo sapiens
agtggcctatttaag

SEQ ID NO: 37311 - DNA, 15 bp, Homo sapiens
aagtggcctatttaa

SEQ ID NO: 37312 - DNA, 15 bp, Homo sapiens
gaagtggcctattta

SEQ ID NO: 37313 - DNA, 15 bp, Homo sapiens
ggaagtggcctattt

SEQ ID NO: 37314 - DNA, 15 bp, Homo sapiens
gggaagtggcctatt

SEQ ID NO: 37315 - DNA, 15 bp, Homo sapiens
ggggaagtggcctat

SEQ ID NO: 37316 - DNA, 15 bp, Homo sapiens
tggggaagtggccta

SEQ ID NO: 37317 - DNA, 15 bp, Homo sapiens
gtggggaagtggcct

SEQ ID NO: 37318 - DNA, 15 bp, Homo sapiens
agtggggaagtggcc

SEQ ID NO: 37319 - DNA, 15 bp, Homo sapiens
gagtggggaagtggc

SEQ ID NO: 37320 - DNA, 15 bp, Homo sapiens
ggagtggggaagtgg

SEQ ID NO: 37321 - DNA, 15 bp, Homo sapiens
gggagtggggaagtg

SEQ ID NO: 37322 - DNA, 15 bp, Homo sapiens
ggggagtggggaagt

SEQ ID NO: 37323 - DNA, 15 bp, Homo sapiens
gggggagtggggaag

SEQ ID NO: 37324 - DNA, 15 bp, Homo sapiens
tgggggagtggggaa

SEQ ID NO: 37325 - DNA, 15 bp, Homo sapiens
gtgggggagtgggga

SEQ ID NO: 37326 - DNA, 15 bp, Homo sapiens
ggtgggggagtgggg

SEQ ID NO: 37327 - DNA, 15 bp, Homo sapiens
gggtgggggagtggg

SEQ ID NO: 37328 - DNA, 15 bp, Homo sapiens
ggggtgggggagtgg

SEQ ID NO: 37329 - DNA, 15 bp, Homo sapiens
gggggtgggggagtg

SEQ ID NO: 37330 - DNA, 15 bp, Homo sapiens
ggggggtgggggagt

SEQ ID NO: 37331 - DNA, 15 bp, Homo sapiens
gggggggtgggggag

SEQ ID NO: 37332 - DNA, 15 bp, Homo sapiens
agggggggtggggga

SEQ ID NO: 37333 - DNA, 15 bp, Homo sapiens
aagggggggtggggg

SEQ ID NO: 37334 - DNA, 15 bp, Homo sapiens
caagggggggtgggg

SEQ ID NO: 37335 - DNA, 15 bp, Homo sapiens
gcaagggggggtggg

SEQ ID NO: 37336 - DNA, 15 bp, Homo sapiens
agcaagggggggtgg

SEQ ID NO: 37337 - DNA, 15 bp, Homo sapiens
aagcaagggggggtg

SEQ ID NO: 37338 - DNA, 15 bp, Homo sapiens
caagcaagggggggt

SEQ ID NO: 37339 - DNA, 15 bp, Homo sapiens
ccaagcaaggggggg

SEQ ID NO: 37340 - DNA, 15 bp, Homo sapiens
accaagcaagggggg

SEQ ID NO: 37341 - DNA, 15 bp, Homo sapiens
gaccaagcaaggggg

SEQ ID NO: 37342 - DNA, 15 bp, Homo sapiens
agaccaagcaagggg

SEQ ID NO: 37343 - DNA, 15 bp, Homo sapiens
aagaccaagcaaggg

SEQ ID NO: 37344 - DNA, 15 bp, Homo sapiens
caagaccaagcaagg

SEQ ID NO: 37345 - DNA, 15 bp, Homo sapiens
acaagaccaagcaag

SEQ ID NO: 37346 - DNA, 15 bp, Homo sapiens
gacaagaccaagcaa

SEQ ID NO: 37347 - DNA, 15 bp, Homo sapiens
ggacaagaccaagca

SEQ ID NO: 37348 - DNA, 15 bp, Homo sapiens
aggacaagaccaagc

SEQ ID NO: 37349 - DNA, 15 bp, Homo sapiens
aaggacaagaccaag

SEQ ID NO: 37350 - DNA, 15 bp, Homo sapiens
caaggacaagaccaa

SEQ ID NO: 37351 - DNA, 15 bp, Homo sapiens
ccaaggacaagacca

SEQ ID NO: 37352 - DNA, 15 bp, Homo sapiens
accaaggacaagacc

SEQ ID NO: 37353 - DNA, 15 bp, Homo sapiens
caccaaggacaagac

SEQ ID NO: 37354 - DNA, 15 bp, Homo sapiens
ccaccaaggacaaga

SEQ ID NO: 37355 - DNA, 15 bp, Homo sapiens
gccaccaaggacaag

SEQ ID NO: 37356 - DNA, 15 bp, Homo sapiens
agccaccaaggacaa

SEQ ID NO: 37357 - DNA, 15 bp, Homo sapiens
tagccaccaaggaca

SEQ ID NO: 37358 - DNA, 15 bp, Homo sapiens
ttagccaccaaggac

SEQ ID NO: 37359 - DNA, 15 bp, Homo sapiens
cttagccaccaagga

SEQ ID NO: 37360 - DNA, 15 bp, Homo sapiens
tcttagccaccaagg

SEQ ID NO: 37361 - DNA, 15 bp, Homo sapiens
gtcttagccaccaag

SEQ ID NO: 37362 - DNA, 15 bp, Homo sapiens
agtcttagccaccaa

SEQ ID NO: 37363 - DNA, 15 bp, Homo sapiens
aagtcttagccacca

SEQ ID NO: 37364 - DNA, 15 bp, Homo sapiens
taagtcttagccacc

SEQ ID NO: 37365 - DNA, 15 bp, Homo sapiens
ctaagtcttagccac

SEQ ID NO: 37366 - DNA, 15 bp, Homo sapiens
gctaagtcttagcca

SEQ ID NO: 37367 - DNA, 15 bp, Homo sapiens
agctaagtcttagcc

SEQ ID NO: 37368 - DNA, 15 bp, Homo sapiens
gagctaagtcttagc

SEQ ID NO: 37369 - DNA, 15 bp, Homo sapiens
agagctaagtcttag

SEQ ID NO: 37370 - DNA, 15 bp, Homo sapiens
cagagctaagtctta

SEQ ID NO: 37371 - DNA, 15 bp, Homo sapiens
gcagagctaagtctt

SEQ ID NO: 37372 - DNA, 15 bp, Homo sapiens
tgcagagctaagtct

SEQ ID NO: 37373 - DNA, 15 bp, Homo sapiens
ctgcagagctaagtc

SEQ ID NO: 37374 - DNA, 15 bp, Homo sapiens
cctgcagagctaagt

SEQ ID NO: 37375 - DNA, 15 bp, Homo sapiens
ccctgcagagctaag

SEQ ID NO: 37376 - DNA, 15 bp, Homo sapiens
cccctgcagagctaa

SEQ ID NO: 37377 - DNA, 15 bp, Homo sapiens
tcccctgcagagcta

SEQ ID NO: 37378 - DNA, 15 bp, Homo sapiens
atcccctgcagagct

SEQ ID NO: 37379 - DNA, 15 bp, Homo sapiens
catcccctgcagagc

SEQ ID NO: 37380 - DNA, 15 bp, Homo sapiens
acatcccctgcagag

SEQ ID NO: 37381 - DNA, 15 bp, Homo sapiens
aacatcccctgcaga

SEQ ID NO: 37382 - DNA, 15 bp, Homo sapiens
taacatcccctgcag

SEQ ID NO: 37383 - DNA, 15 bp, Homo sapiens
ttaacatcccctgca

SEQ ID NO: 37384 - DNA, 15 bp, Homo sapiens
tttaacatcccctgc

SEQ ID NO: 37385 - DNA, 15 bp, Homo sapiens
ctttaacatcccctg

SEQ ID NO: 37386 - DNA, 15 bp, Homo sapiens
gctttaacatcccct

SEQ ID NO: 37387 - DNA, 15 bp, Homo sapiens
tgctttaacatcccc

SEQ ID NO: 37388 - DNA, 15 bp, Homo sapiens
gtgctttaacatccc

SEQ ID NO: 37389 - DNA, 15 bp, Homo sapiens
tgtgctttaacatcc

SEQ ID NO: 37390 - DNA, 15 bp, Homo sapiens
ctgtgctttaacatc

SEQ ID NO: 37391 - DNA, 15 bp, Homo sapiens
actgtgctttaacat

SEQ ID NO: 37392 - DNA, 15 bp, Homo sapiens
aactgtgctttaaca

SEQ ID NO: 37393 - DNA, 15 bp, Homo sapiens
taactgtgctttaac

SEQ ID NO: 37394 - DNA, 15 bp, Homo sapiens
ctaactgtgctttaa

SEQ ID NO: 37395 - DNA, 15 bp, Homo sapiens
actaactgtgcttta

SEQ ID NO: 37396 - DNA, 15 bp, Homo sapiens
tactaactgtgcttt

SEQ ID NO: 37397 - DNA, 15 bp, Homo sapiens
ctactaactgtgctt

SEQ ID NO: 37398 - DNA, 15 bp, Homo sapiens
cctactaactgtgct

SEQ ID NO: 37399 - DNA, 15 bp, Homo sapiens
tcctactaactgtgc

SEQ ID NO: 37400 - DNA, 15 bp, Homo sapiens
gtcctactaactgtg

SEQ ID NO: 37401 - DNA, 15 bp, Homo sapiens
cgtcctactaactgt

SEQ ID NO: 37402 - DNA, 15 bp, Homo sapiens
acgtcctactaactg

SEQ ID NO: 37403 - DNA, 15 bp, Homo sapiens
cacgtcctactaact

SEQ ID NO: 37404 - DNA, 15 bp, Homo sapiens
ccacgtcctactaac

SEQ ID NO: 37405 - DNA, 15 bp, Homo sapiens
gccacgtcctactaa

SEQ ID NO: 37406 - DNA, 15 bp, Homo sapiens
agccacgtcctacta

SEQ ID NO: 37407 - DNA, 15 bp, Homo sapiens
gagccacgtcctact

SEQ ID NO: 37408 - DNA, 15 bp, Homo sapiens
agagccacgtcctac

SEQ ID NO: 37409 - DNA, 15 bp, Homo sapiens
cagagccacgtccta

SEQ ID NO: 37410 - DNA, 15 bp, Homo sapiens
gcagagccacgtcct

SEQ ID NO: 37411 - DNA, 15 bp, Homo sapiens
tgcagagccacgtcc

SEQ ID NO: 37412 - DNA, 15 bp, Homo sapiens
gtgcagagccacgtc

SEQ ID NO: 37413 - DNA, 15 bp, Homo sapiens
tgtgcagagccacgt

SEQ ID NO: 37414 - DNA, 15 bp, Homo sapiens
ctgtgcagagccacg

SEQ ID NO: 37415 - DNA, 15 bp, Homo sapiens
gctgtgcagagccac

SEQ ID NO: 37416 - DNA, 15 bp, Homo sapiens
ggctgtgcagagcca

SEQ ID NO: 37417 - DNA, 15 bp, Homo sapiens
gggctgtgcagagcc

SEQ ID NO: 37418 - DNA, 15 bp, Homo sapiens
tgggctgtgcagagc

SEQ ID NO: 37419 - DNA, 15 bp, Homo sapiens
ttgggctgtgcagag

SEQ ID NO: 37420 - DNA, 15 bp, Homo sapiens
tttgggctgtgcaga

SEQ ID NO: 37421 - DNA, 15 bp, Homo sapiens
ttttgggctgtgcag

SEQ ID NO: 37422 - DNA, 15 bp, Homo sapiens
tttttgggctgtgca

SEQ ID NO: 37423 - DNA, 15 bp, Homo sapiens
gtttttgggctgtgc

SEQ ID NO: 37424 - DNA, 15 bp, Homo sapiens
ggtttttgggctgtg

SEQ ID NO: 37425 - DNA, 15 bp, Homo sapiens
tggtttttgggctgt

SEQ ID NO: 37426 - DNA, 15 bp, Homo sapiens
ctggtttttgggctg

SEQ ID NO: 37427 - DNA, 15 bp, Homo sapiens
gctggtttttgggct

SEQ ID NO: 37428 - DNA, 15 bp, Homo sapiens
agctggtttttgggc

SEQ ID NO: 37429 - DNA, 15 bp, Homo sapiens
aagctggtttttggg

SEQ ID NO: 37430 - DNA, 15 bp, Homo sapiens
taagctggtttttgg

SEQ ID NO: 37431 - DNA, 15 bp, Homo sapiens
gtaagctggtttttg

SEQ ID NO: 37432 - DNA, 15 bp, Homo sapiens
agtaagctggttttt

SEQ ID NO: 37433 - DNA, 15 bp, Homo sapiens
gagtaagctggtttt

SEQ ID NO: 37434 - DNA, 15 bp, Homo sapiens
ggagtaagctggttt

SEQ ID NO: 37435 - DNA, 15 bp, Homo sapiens
aggagtaagctggtt

SEQ ID NO: 37436 - DNA, 15 bp, Homo sapiens
aaggagtaagctggt

SEQ ID NO: 37437 - DNA, 15 bp, Homo sapiens
taaggagtaagctgg

SEQ ID NO: 37438 - DNA, 15 bp, Homo sapiens
ctaaggagtaagctg

SEQ ID NO: 37439 - DNA, 15 bp, Homo sapiens
gctaaggagtaagct

SEQ ID NO: 37440 - DNA, 15 bp, Homo sapiens
ggctaaggagtaagc

SEQ ID NO: 37441 - DNA, 15 bp, Homo sapiens
tggctaaggagtaag

SEQ ID NO: 37442 - DNA, 15 bp, Homo sapiens
ctggctaaggagtaa

SEQ ID NO: 37443 - DNA, 15 bp, Homo sapiens
cctggctaaggagta

SEQ ID NO: 37444 - DNA, 15 bp, Homo sapiens
ccctggctaaggagt

SEQ ID NO: 37445 - DNA, 15 bp, Homo sapiens
accctggctaaggag

SEQ ID NO: 37446 - DNA, 15 bp, Homo sapiens
caccctggctaagga

SEQ ID NO: 37447 - DNA, 15 bp, Homo sapiens
acaccctggctaagg

SEQ ID NO: 37448 - DNA, 15 bp, Homo sapiens
cacaccctggctaag

SEQ ID NO: 37449 - DNA, 15 bp, Homo sapiens
tcacaccctggctaa

SEQ ID NO: 37450 - DNA, 15 bp, Homo sapiens
ctcacaccctggcta

SEQ ID NO: 37451 - DNA, 15 bp, Homo sapiens
cctcacaccctggct

SEQ ID NO: 37452 - DNA, 15 bp, Homo sapiens
gcctcacaccctggc

SEQ ID NO: 37453 - DNA, 15 bp, Homo sapiens
ggcctcacaccctgg

SEQ ID NO: 37454 - DNA, 15 bp, Homo sapiens
aggcctcacaccctg

SEQ ID NO: 37455 - DNA, 15 bp, Homo sapiens
gaggcctcacaccct

SEQ ID NO: 37456 - DNA, 15 bp, Homo sapiens
cgaggcctcacaccc

SEQ ID NO: 37457 - DNA, 15 bp, Homo sapiens
tcgaggcctcacacc

SEQ ID NO: 37458 - DNA, 15 bp, Homo sapiens
gtcgaggcctcacac

SEQ ID NO: 37459 - DNA, 15 bp, Homo sapiens
agtcgaggcctcaca

SEQ ID NO: 37460 - DNA, 15 bp, Homo sapiens
tagtcgaggcctcac

SEQ ID NO: 37461 - DNA, 15 bp, Homo sapiens
atagtcgaggcctca

SEQ ID NO: 37462 - DNA, 15 bp, Homo sapiens
tatagtcgaggcctc

SEQ ID NO: 37463 - DNA, 15 bp, Homo sapiens
atatagtcgaggcct

SEQ ID NO: 37464 - DNA, 15 bp, Homo sapiens
aatatagtcgaggcc

SEQ ID NO: 37465 - DNA, 15 bp, Homo sapiens
gaatatagtcgaggc

SEQ ID NO: 37466 - DNA, 15 bp, Homo sapiens
agaatatagtcgagg

SEQ ID NO: 37467 - DNA, 15 bp, Homo sapiens
aagaatatagtcgag

SEQ ID NO: 37468 - DNA, 15 bp, Homo sapiens
gaagaatatagtcga

SEQ ID NO: 37469 - DNA, 15 bp, Homo sapiens
tgaagaatatagtcg

SEQ ID NO: 37470 - DNA, 15 bp, Homo sapiens
ttgaagaatatagtc

SEQ ID NO: 37471 - DNA, 15 bp, Homo sapiens
tttgaagaatatagt

SEQ ID NO: 37472 - DNA, 15 bp, Homo sapiens
ttttgaagaatatag

SEQ ID NO: 37473 - DNA, 15 bp, Homo sapiens
attttgaagaatata

SEQ ID NO: 37474 - DNA, 15 bp, Homo sapiens
cattttgaagaatat

SEQ ID NO: 37475 - DNA, 15 bp, Homo sapiens
acattttgaagaata

SEQ ID NO: 37476 - DNA, 15 bp, Homo sapiens
tacattttgaagaat

SEQ ID NO: 37477 - DNA, 15 bp, Homo sapiens
gtacattttgaagaa

SEQ ID NO: 37478 - DNA, 15 bp, Homo sapiens
agtacattttgaaga

SEQ ID NO: 37479 - DNA, 15 bp, Homo sapiens
aagtacattttgaag

SEQ ID NO: 37480 - DNA, 15 bp, Homo sapiens
taagtacattttgaa

SEQ ID NO: 37481 - DNA, 15 bp, Homo sapiens
ctaagtacattttga

SEQ ID NO: 37482 - DNA, 15 bp, Homo sapiens
cctaagtacattttg

SEQ ID NO: 37483 - DNA, 15 bp, Homo sapiens
gcctaagtacatttt

SEQ ID NO: 37484 - DNA, 15 bp, Homo sapiens
agcctaagtacattt

SEQ ID NO: 37485 - DNA, 15 bp, Homo sapiens
gagcctaagtacatt

SEQ ID NO: 37486 - DNA, 15 bp, Homo sapiens
agagcctaagtacat

SEQ ID NO: 37487 - DNA, 15 bp, Homo sapiens
cagagcctaagtaca

SEQ ID NO: 37488 - DNA, 15 bp, Homo sapiens
ccagagcctaagtac

SEQ ID NO: 37489 - DNA, 15 bp, Homo sapiens
accagagcctaagta

SEQ ID NO: 37490 - DNA, 15 bp, Homo sapiens
aaccagagcctaagt

SEQ ID NO: 37491 - DNA, 15 bp, Homo sapiens
taaccagagcctaag

SEQ ID NO: 37492 - DNA, 15 bp, Homo sapiens
gtaaccagagcctaa

SEQ ID NO: 37493 - DNA, 15 bp, Homo sapiens
agtaaccagagccta

SEQ ID NO: 37494 - DNA, 15 bp, Homo sapiens
cagtaaccagagcct

SEQ ID NO: 37495 - DNA, 15 bp, Homo sapiens
ccagtaaccagagcc

SEQ ID NO: 37496 - DNA, 15 bp, Homo sapiens
cccagtaaccagagc

SEQ ID NO: 37497 - DNA, 15 bp, Homo sapiens
tcccagtaaccagag

SEQ ID NO: 37498 - DNA, 15 bp, Homo sapiens
atcccagtaaccaga

SEQ ID NO: 37499 - DNA, 15 bp, Homo sapiens
catcccagtaaccag

SEQ ID NO: 37500 - DNA, 15 bp, Homo sapiens
ccatcccagtaacca

SEQ ID NO: 37501 - DNA, 15 bp, Homo sapiens
gccatcccagtaacc

SEQ ID NO: 37502 - DNA, 15 bp, Homo sapiens
ggccatcccagtaac

SEQ ID NO: 37503 - DNA, 15 bp, Homo sapiens
tggccatcccagtaa

SEQ ID NO: 37504 - DNA, 15 bp, Homo sapiens
ctggccatcccagta

SEQ ID NO: 37505 - DNA, 15 bp, Homo sapiens
actggccatcccagt

SEQ ID NO: 37506 - DNA, 15 bp, Homo sapiens
tactggccatcccag

SEQ ID NO: 37507 - DNA, 15 bp, Homo sapiens
ctactggccatccca

SEQ ID NO: 37508 - DNA, 15 bp, Homo sapiens
tctactggccatccc

SEQ ID NO: 37509 - DNA, 15 bp, Homo sapiens
atctactggccatcc

SEQ ID NO: 37510 - DNA, 15 bp, Homo sapiens
catctactggccatc

SEQ ID NO: 37511 - DNA, 15 bp, Homo sapiens
acatctactggccat

SEQ ID NO: 37512 - DNA, 15 bp, Homo sapiens
tacatctactggcca

SEQ ID NO: 37513 - DNA, 15 bp, Homo sapiens
ttacatctactggcc

SEQ ID NO: 37514 - DNA, 15 bp, Homo sapiens
attacatctactggc

SEQ ID NO: 37515 - DNA, 15 bp, Homo sapiens
cattacatctactgg

SEQ ID NO: 37516 - DNA, 15 bp, Homo sapiens
gcattacatctactg

SEQ ID NO: 37517 - DNA, 15 bp, Homo sapiens
tgcattacatctact

SEQ ID NO: 37518 - DNA, 15 bp, Homo sapiens
ctgcattacatctac

SEQ ID NO: 37519 - DNA, 15 bp, Homo sapiens
tctgcattacatcta

SEQ ID NO: 37520 - DNA, 15 bp, Homo sapiens
atctgcattacatct

SEQ ID NO: 37521 - DNA, 15 bp, Homo sapiens
catctgcattacatc

SEQ ID NO: 37522 - DNA, 15 bp, Homo sapiens
ccatctgcattacat

SEQ ID NO: 37523 - DNA, 15 bp, Homo sapiens
accatctgcattaca

SEQ ID NO: 37524 - DNA, 15 bp, Homo sapiens
aaccatctgcattac

SEQ ID NO: 37525 - DNA, 15 bp, Homo sapiens
caaccatctgcatta

SEQ ID NO: 37526 - DNA, 15 bp, Homo sapiens
ccaaccatctgcatt

SEQ ID NO: 37527 - DNA, 15 bp, Homo sapiens
tccaaccatctgcat

SEQ ID NO: 37528 - DNA, 15 bp, Homo sapiens
ctccaaccatctgca

SEQ ID NO: 37529 - DNA, 15 bp, Homo sapiens
actccaaccatctgc

SEQ ID NO: 37530 - DNA, 15 bp, Homo sapiens
aactccaaccatctg

SEQ ID NO: 37531 - DNA, 15 bp, Homo sapiens
aaactccaaccatct

SEQ ID NO: 37532 - DNA, 15 bp, Homo sapiens
caaactccaaccatc

SEQ ID NO: 37533 - DNA, 15 bp, Homo sapiens
ccaaactccaaccat

SEQ ID NO: 37534 - DNA, 15 bp, Homo sapiens
cccaaactccaacca

SEQ ID NO: 37535 - DNA, 15 bp, Homo sapiens
ccccaaactccaacc

SEQ ID NO: 37536 - DNA, 15 bp, Homo sapiens
tccccaaactccaac

SEQ ID NO: 37537 - DNA, 15 bp, Homo sapiens
ctccccaaactccaa

SEQ ID NO: 37538 - DNA, 15 bp, Homo sapiens
cctccccaaactcca

SEQ ID NO: 37539 - DNA, 15 bp, Homo sapiens
ccctccccaaactcc

SEQ ID NO: 37540 - DNA, 15 bp, Homo sapiens
accctccccaaactc

SEQ ID NO: 37541 - DNA, 15 bp, Homo sapiens
aaccctccccaaact

SEQ ID NO: 37542 - DNA, 15 bp, Homo sapiens
taaccctccccaaac

SEQ ID NO: 37543 - DNA, 15 bp, Homo sapiens
ctaaccctccccaaa

SEQ ID NO: 37544 - DNA, 15 bp, Homo sapiens
cctaaccctccccaa

SEQ ID NO: 37545 - DNA, 15 bp, Homo sapiens
tcctaaccctcccca

SEQ ID NO: 37546 - DNA, 15 bp, Homo sapiens
ctcctaaccctcccc

SEQ ID NO: 37547 - DNA, 15 bp, Homo sapiens
cctcctaaccctccc

SEQ ID NO: 37548 - DNA, 15 bp, Homo sapiens
gcctcctaaccctcc

SEQ ID NO: 37549 - DNA, 15 bp, Homo sapiens
tgcctcctaaccctc

SEQ ID NO: 37550 - DNA, 15 bp, Homo sapiens
atgcctcctaaccct

SEQ ID NO: 37551 - DNA, 15 bp, Homo sapiens
gatgcctcctaaccc

SEQ ID NO: 37552 - DNA, 15 bp, Homo sapiens
tgatgcctcctaacc

SEQ ID NO: 37553 - DNA, 15 bp, Homo sapiens
ttgatgcctcctaac

SEQ ID NO: 37554 - DNA, 15 bp, Homo sapiens
cttgatgcctcctaa

SEQ ID NO: 37555 - DNA, 15 bp, Homo sapiens
gcttgatgcctccta

SEQ ID NO: 37556 - DNA, 15 bp, Homo sapiens
tgcttgatgcctcct

SEQ ID NO: 37557 - DNA, 15 bp, Homo sapiens
ctgcttgatgcctcc

SEQ ID NO: 37558 - DNA, 15 bp, Homo sapiens
cctgcttgatgcctc

SEQ ID NO: 37559 - DNA, 15 bp, Homo sapiens
tcctgcttgatgcct

SEQ ID NO: 37560 - DNA, 15 bp, Homo sapiens
gtcctgcttgatgcc

SEQ ID NO: 37561 - DNA, 15 bp, Homo sapiens
tgtcctgcttgatgc

SEQ ID NO: 37562 - DNA, 15 bp, Homo sapiens
ttgtcctgcttgatg

SEQ ID NO: 37563 - DNA, 15 bp, Homo sapiens
cttgtcctgcttgat

SEQ ID NO: 37564 - DNA, 15 bp, Homo sapiens
ccttgtcctgcttga

SEQ ID NO: 37565 - DNA, 15 bp, Homo sapiens
accttgtcctgcttg

SEQ ID NO: 37566 - DNA, 15 bp, Homo sapiens
caccttgtcctgctt

SEQ ID NO: 37567 - DNA, 15 bp, Homo sapiens
gcaccttgtcctgct

SEQ ID NO: 37568 - DNA, 15 bp, Homo sapiens
agcaccttgtcctgc

SEQ ID NO: 37569 - DNA, 15 bp, Homo sapiens
cagcaccttgtcctg

SEQ ID NO: 37570 - DNA, 15 bp, Homo sapiens
gcagcaccttgtcct

SEQ ID NO: 37571 - DNA, 15 bp, Homo sapiens
agcagcaccttgtcc

SEQ ID NO: 37572 - DNA, 15 bp, Homo sapiens
cagcagcaccttgtc

SEQ ID NO: 37573 - DNA, 15 bp, Homo sapiens
tcagcagcaccttgt

SEQ ID NO: 37574 - DNA, 15 bp, Homo sapiens
ctcagcagcaccttg

SEQ ID NO: 37575 - DNA, 15 bp, Homo sapiens
actcagcagcacctt

SEQ ID NO: 37576 - DNA, 15 bp, Homo sapiens
aactcagcagcacct

SEQ ID NO: 37577 - DNA, 15 bp, Homo sapiens
gaactcagcagcacc

SEQ ID NO: 37578 - DNA, 15 bp, Homo sapiens
tgaactcagcagcac

SEQ ID NO: 37579 - DNA, 15 bp, Homo sapiens
ctgaactcagcagca

SEQ ID NO: 37580 - DNA, 15 bp, Homo sapiens
tctgaactcagcagc

SEQ ID NO: 37581 - DNA, 15 bp, Homo sapiens
ctctgaactcagcag

SEQ ID NO: 37582 - DNA, 15 bp, Homo sapiens
cctctgaactcagca

SEQ ID NO: 37583 - DNA, 15 bp, Homo sapiens
ccctctgaactcagc

SEQ ID NO: 37584 - DNA, 15 bp, Homo sapiens
gccctctgaactcag

SEQ ID NO: 37585 - DNA, 15 bp, Homo sapiens
ggccctctgaactca

SEQ ID NO: 37586 - DNA, 15 bp, Homo sapiens
gggccctctgaactc

SEQ ID NO: 37587 - DNA, 15 bp, Homo sapiens
tgggccctctgaact

SEQ ID NO: 37588 - DNA, 15 bp, Homo sapiens
gtgggccctctgaac

SEQ ID NO: 37589 - DNA, 15 bp, Homo sapiens
cgtgggccctctgaa

SEQ ID NO: 37590 - DNA, 15 bp, Homo sapiens
acgtgggccctctga

SEQ ID NO: 37591 - DNA, 15 bp, Homo sapiens
aacgtgggccctctg

SEQ ID NO: 37592 - DNA, 15 bp, Homo sapiens
gaacgtgggccctct

SEQ ID NO: 37593 - DNA, 15 bp, Homo sapiens
tgaacgtgggccctc

SEQ ID NO: 37594 - DNA, 15 bp, Homo sapiens
ttgaacgtgggccct

SEQ ID NO: 37595 - DNA, 15 bp, Homo sapiens
cttgaacgtgggccc

SEQ ID NO: 37596 - DNA, 15 bp, Homo sapiens
ccttgaacgtgggcc

SEQ ID NO: 37597 - DNA, 15 bp, Homo sapiens
cccttgaacgtgggc

SEQ ID NO: 37598 - DNA, 15 bp, Homo sapiens
tcccttgaacgtggg

SEQ ID NO: 37599 - DNA, 15 bp, Homo sapiens
atcccttgaacgtgg

SEQ ID NO: 37600 - DNA, 15 bp, Homo sapiens
catcccttgaacgtg

SEQ ID NO: 37601 - DNA, 15 bp, Homo sapiens
ccatcccttgaacgt

SEQ ID NO: 37602 - DNA, 15 bp, Homo sapiens
tccatcccttgaacg

SEQ ID NO: 37603 - DNA, 15 bp, Homo sapiens
ctccatcccttgaac

SEQ ID NO: 37604 - DNA, 15 bp, Homo sapiens
cctccatcccttgaa

SEQ ID NO: 37605 - DNA, 15 bp, Homo sapiens
acctccatcccttga

SEQ ID NO: 37606 - DNA, 15 bp, Homo sapiens
cacctccatcccttg

SEQ ID NO: 37607 - DNA, 15 bp, Homo sapiens
ccacctccatccctt

SEQ ID NO: 37608 - DNA, 15 bp, Homo sapiens
tccacctccatccct

SEQ ID NO: 37609 - DNA, 15 bp, Homo sapiens
ttccacctccatccc

SEQ ID NO: 37610 - DNA, 15 bp, Homo sapiens
gttccacctccatcc

SEQ ID NO: 37611 - DNA, 15 bp, Homo sapiens
ggttccacctccatc

SEQ ID NO: 37612 - DNA, 15 bp, Homo sapiens
aggttccacctccat

SEQ ID NO: 37613 - DNA, 15 bp, Homo sapiens
caggttccacctcca

SEQ ID NO: 37614 - DNA, 15 bp, Homo sapiens
ccaggttccacctcc

SEQ ID NO: 37615 - DNA, 15 bp, Homo sapiens
tccaggttccacctc

SEQ ID NO: 37616 - DNA, 15 bp, Homo sapiens
ctccaggttccacct

SEQ ID NO: 37617 - DNA, 15 bp, Homo sapiens
tctccaggttccacc

SEQ ID NO: 37618 - DNA, 15 bp, Homo sapiens
gtctccaggttccac

SEQ ID NO: 37619 - DNA, 15 bp, Homo sapiens
ggtctccaggttcca

SEQ ID NO: 37620 - DNA, 15 bp, Homo sapiens
cggtctccaggttcc

SEQ ID NO: 37621 - DNA, 15 bp, Homo sapiens
tcggtctccaggttc

SEQ ID NO: 37622 - DNA, 15 bp, Homo sapiens
gtcggtctccaggtt

SEQ ID NO: 37623 - DNA, 15 bp, Homo sapiens
agtcggtctccaggt

SEQ ID NO: 37624 - DNA, 15 bp, Homo sapiens
gagtcggtctccagg

SEQ ID NO: 37625 - DNA, 15 bp, Homo sapiens
agagtcggtctccag

SEQ ID NO: 37626 - DNA, 15 bp, Homo sapiens
aagagtcggtctcca

SEQ ID NO: 37627 - DNA, 15 bp, Homo sapiens
taagagtcggtctcc

SEQ ID NO: 37628 - DNA, 15 bp, Homo sapiens
ttaagagtcggtctc

SEQ ID NO: 37629 - DNA, 15 bp, Homo sapiens
tttaagagtcggtct

SEQ ID NO: 37630 - DNA, 15 bp, Homo sapiens
ttttaagagtcggtc

SEQ ID NO: 37631 - DNA, 15 bp, Homo sapiens
cttttaagagtcggt

SEQ ID NO: 37632 - DNA, 15 bp, Homo sapiens
gcttttaagagtcgg

SEQ ID NO: 37633 - DNA, 15 bp, Homo sapiens
tgcttttaagagtcg

SEQ ID NO: 37634 - DNA, 15 bp, Homo sapiens
gtgcttttaagagtc

SEQ ID NO: 37635 - DNA, 15 bp, Homo sapiens
tgtgcttttaagagt

SEQ ID NO: 37636 - DNA, 15 bp, Homo sapiens
ctgtgcttttaagag

SEQ ID NO: 37637 - DNA, 15 bp, Homo sapiens
actgtgcttttaaga

SEQ ID NO: 37638 - DNA, 15 bp, Homo sapiens
gactgtgcttttaag

SEQ ID NO: 37639 - DNA, 15 bp, Homo sapiens
ggactgtgcttttaa

SEQ ID NO: 37640 - DNA, 15 bp, Homo sapiens
cggactgtgctttta

SEQ ID NO: 37641 - DNA, 15 bp, Homo sapiens
acggactgtgctttt

SEQ ID NO: 37642 - DNA, 15 bp, Homo sapiens
cacggactgtgcttt

SEQ ID NO: 37643 - DNA, 15 bp, Homo sapiens
ccacggactgtgctt

SEQ ID NO: 37644 - DNA, 15 bp, Homo sapiens
accacggactgtgct

SEQ ID NO: 37645 - DNA, 15 bp, Homo sapiens
aaccacggactgtgc

SEQ ID NO: 37646 - DNA, 15 bp, Homo sapiens
caaccacggactgtg

SEQ ID NO: 37647 - DNA, 15 bp, Homo sapiens
ccaaccacggactgt

SEQ ID NO: 37648 - DNA, 15 bp, Homo sapiens
cccaaccacggactg

SEQ ID NO: 37649 - DNA, 15 bp, Homo sapiens
acccaaccacggact

SEQ ID NO: 37650 - DNA, 15 bp, Homo sapiens
cacccaaccacggac

SEQ ID NO: 37651 - DNA, 15 bp, Homo sapiens
acacccaaccacgga

SEQ ID NO: 37652 - DNA, 15 bp, Homo sapiens
cacacccaaccacgg

SEQ ID NO: 37653 - DNA, 15 bp, Homo sapiens
ccacacccaaccacg

SEQ ID NO: 37654 - DNA, 15 bp, Homo sapiens
accacacccaaccac

SEQ ID NO: 37655 - DNA, 15 bp, Homo sapiens
caccacacccaacca

SEQ ID NO: 37656 - DNA, 15 bp, Homo sapiens
ccaccacacccaacc

SEQ ID NO: 37657 - DNA, 15 bp, Homo sapiens
gccaccacacccaac

SEQ ID NO: 37658 - DNA, 15 bp, Homo sapiens
agccaccacacccaa

SEQ ID NO: 37659 - DNA, 15 bp, Homo sapiens
gagccaccacaccca

SEQ ID NO: 37660 - DNA, 15 bp, Homo sapiens
tgagccaccacaccc

SEQ ID NO: 37661 - DNA, 15 bp, Homo sapiens
atgagccaccacacc

SEQ ID NO: 37662 - DNA, 15 bp, Homo sapiens
catgagccaccacac

SEQ ID NO: 37663 - DNA, 15 bp, Homo sapiens
gcatgagccaccaca

SEQ ID NO: 37664 - DNA, 15 bp, Homo sapiens
cttacaggcatgagc

SEQ ID NO: 37665 - DNA, 15 bp, Homo sapiens
acttacaggcatgag

SEQ ID NO: 37666 - DNA, 15 bp, Homo sapiens
tacttacaggcatga

SEQ ID NO: 37667 - DNA, 15 bp, Homo sapiens
ttacttacaggcatg

SEQ ID NO: 37668 - DNA, 15 bp, Homo sapiens
cttacttacaggcat

SEQ ID NO: 37669 - DNA, 15 bp, Homo sapiens
acttacttacaggca

SEQ ID NO: 37670 - DNA, 15 bp, Homo sapiens
gacttacttacaggc

SEQ ID NO: 37671 - DNA, 15 bp, Homo sapiens
agacttacttacagg

SEQ ID NO: 37672 - DNA, 15 bp, Homo sapiens
gagacttacttacag

SEQ ID NO: 37673 - DNA, 15 bp, Homo sapiens
tgagacttacttaca

SEQ ID NO: 37674 - DNA, 15 bp, Homo sapiens
ctgagacttacttac

SEQ ID NO: 37675 - DNA, 15 bp, Homo sapiens
gctgagacttactta

SEQ ID NO: 37676 - DNA, 15 bp, Homo sapiens
ggctgagacttactt

SEQ ID NO: 37677 - DNA, 15 bp, Homo sapiens
gggctgagacttact

SEQ ID NO: 37678 - DNA, 15 bp, Homo sapiens
agggctgagacttac

SEQ ID NO: 37679 - DNA, 15 bp, Homo sapiens
aagggctgagactta

SEQ ID NO: 37680 - DNA, 15 bp, Homo sapiens
aaagggctgagactt

SEQ ID NO: 37681 - DNA, 15 bp, Homo sapiens
caaagggctgagact

SEQ ID NO: 37682 - DNA, 15 bp, Homo sapiens
ccaaagggctgagac

SEQ ID NO: 37683 - DNA, 15 bp, Homo sapiens
tccaaagggctgaga

SEQ ID NO: 37684 - DNA, 15 bp, Homo sapiens
ctccaaagggctgag

SEQ ID NO: 37685 - DNA, 15 bp, Homo sapiens
cctccaaagggctga

SEQ ID NO: 37686 - DNA, 15 bp, Homo sapiens
gcctccaaagggctg

SEQ ID NO: 37687 - DNA, 15 bp, Homo sapiens
ggcctccaaagggct

SEQ ID NO: 37688 - DNA, 15 bp, Homo sapiens
tggcctccaaagggc

SEQ ID NO: 37689 - DNA, 15 bp, Homo sapiens
gtggcctccaaaggg

SEQ ID NO: 37690 - DNA, 15 bp, Homo sapiens
tgtggcctccaaagg

SEQ ID NO: 37691 - DNA, 15 bp, Homo sapiens
ctgtggcctccaaag

SEQ ID NO: 37692 - DNA, 15 bp, Homo sapiens
gctgtggcctccaaa

SEQ ID NO: 37693 - DNA, 15 bp, Homo sapiens
tgctgtggcctccaa

SEQ ID NO: 37694 - DNA, 15 bp, Homo sapiens
ctgctgtggcctcca

SEQ ID NO: 37695 - DNA, 15 bp, Homo sapiens
tctgctgtggcctcc

SEQ ID NO: 37696 - DNA, 15 bp, Homo sapiens
ttctgctgtggcctc

SEQ ID NO: 37697 - DNA, 15 bp, Homo sapiens
cttctgctgtggcct

SEQ ID NO: 37698 - DNA, 15 bp, Homo sapiens
ccttctgctgtggcc

SEQ ID NO: 37699 - DNA, 15 bp, Homo sapiens
tccttctgctgtggc

SEQ ID NO: 37700 - DNA, 15 bp, Homo sapiens
atccttctgctgtgg

SEQ ID NO: 37701 - DNA, 15 bp, Homo sapiens
aatccttctgctgtg

SEQ ID NO: 37702 - DNA, 15 bp, Homo sapiens
caatccttctgctgt

SEQ ID NO: 37703 - DNA, 15 bp, Homo sapiens
gcaatccttctgctg

SEQ ID NO: 37704 - DNA, 15 bp, Homo sapiens
agcaatccttctgct

SEQ ID NO: 37705 - DNA, 15 bp, Homo sapiens
aagcaatccttctgc

SEQ ID NO: 37706 - DNA, 15 bp, Homo sapiens
caagcaatccttctg

SEQ ID NO: 37707 - DNA, 15 bp, Homo sapiens
tcaagcaatccttct

SEQ ID NO: 37708 - DNA, 15 bp, Homo sapiens
ctcaagcaatccttc

SEQ ID NO: 37709 - DNA, 15 bp, Homo sapiens
gctcaagcaatcctt

SEQ ID NO: 37710 - DNA, 15 bp, Homo sapiens
ggctcaagcaatcct

SEQ ID NO: 37711 - DNA, 15 bp, Homo sapiens
gggctcaagcaatcc

SEQ ID NO: 37712 - DNA, 15 bp, Homo sapiens
acctgggctcaagca

SEQ ID NO: 37713 - DNA, 15 bp, Homo sapiens
tacctgggctcaagc

SEQ ID NO: 37714 - DNA, 15 bp, Homo sapiens
gtacctgggctcaag

SEQ ID NO: 37715 - DNA, 15 bp, Homo sapiens
agtacctgggctcaa

SEQ ID NO: 37716 - DNA, 15 bp, Homo sapiens
gagtacctgggctca

SEQ ID NO: 37717 - DNA, 15 bp, Homo sapiens
tgagtacctgggctc

SEQ ID NO: 37718 - DNA, 15 bp, Homo sapiens
ttgagtacctgggct

SEQ ID NO: 37719 - DNA, 15 bp, Homo sapiens
tttgagtacctgggc

SEQ ID NO: 37720 - DNA, 15 bp, Homo sapiens
gtttgagtacctggg

SEQ ID NO: 37721 - DNA, 15 bp, Homo sapiens
ggtttgagtacctgg

SEQ ID NO: 37722 - DNA, 15 bp, Homo sapiens
tggtttgagtacctg

SEQ ID NO: 37723 - DNA, 15 bp, Homo sapiens
ctggtttgagtacct

SEQ ID NO: 37724 - DNA, 15 bp, Homo sapiens
gctggtttgagtacc

SEQ ID NO: 37725 - DNA, 15 bp, Homo sapiens
ggctggtttgagtac

SEQ ID NO: 37726 - DNA, 15 bp, Homo sapiens
aggctggtttgagta

SEQ ID NO: 37727 - DNA, 15 bp, Homo sapiens
caggctggtttgagt

SEQ ID NO: 37728 - DNA, 15 bp, Homo sapiens
ccaggctggtttgag

SEQ ID NO: 37729 - DNA, 15 bp, Homo sapiens
cccaggctggtttga

SEQ ID NO: 37730 - DNA, 15 bp, Homo sapiens
gcccaggctggtttg

SEQ ID NO: 37731 - DNA, 15 bp, Homo sapiens
tgcccaggctggttt

SEQ ID NO: 37732 - DNA, 15 bp, Homo sapiens
ttgcccaggctggtt

SEQ ID NO: 37733 - DNA, 15 bp, Homo sapiens
ctgttgcccaggctg

SEQ ID NO: 37734 - DNA, 15 bp, Homo sapiens
cactctgttgcccag

SEQ ID NO: 37735 - DNA, 15 bp, Homo sapiens
cctcactctgttgcc

SEQ ID NO: 37736 - DNA, 15 bp, Homo sapiens
gcctcactctgttgc

SEQ ID NO: 37737 - DNA, 15 bp, Homo sapiens
ggcctcactctgttg

SEQ ID NO: 37738 - DNA, 15 bp, Homo sapiens
gggcctcactctgtt

SEQ ID NO: 37739 - DNA, 15 bp, Homo sapiens
agggcctcactctgt

SEQ ID NO: 37740 - DNA, 15 bp, Homo sapiens
cagggcctcactctg

SEQ ID NO: 37741 - DNA, 15 bp, Homo sapiens
acagggcctcactct

SEQ ID NO: 37742 - DNA, 15 bp, Homo sapiens
gacagggcctcactc

SEQ ID NO: 37743 - DNA, 15 bp, Homo sapiens
tgacagggcctcact

SEQ ID NO: 37744 - DNA, 15 bp, Homo sapiens
ttgacagggcctcac

SEQ ID NO: 37745 - DNA, 15 bp, Homo sapiens
tttgacagggcctca

SEQ ID NO: 37746 - DNA, 15 bp, Homo sapiens
ttttgacagggcctc

SEQ ID NO: 37747 - DNA, 15 bp, Homo sapiens
tttttgacagggcct

SEQ ID NO: 37748 - DNA, 15 bp, Homo sapiens
ttttttgacagggcc

SEQ ID NO: 37749 - DNA, 15 bp, Homo sapiens
tttttttgacagggc

SEQ ID NO: 37750 - DNA, 15 bp, Homo sapiens
ttttttttgacaggg

SEQ ID NO: 37751 - DNA, 15 bp, Homo sapiens
tttttttttgacagg

SEQ ID NO: 37752 - DNA, 15 bp, Homo sapiens
atttttttttgacag

SEQ ID NO: 37753 - DNA, 15 bp, Homo sapiens
gatttttttttgaca

SEQ ID NO: 37754 - DNA, 15 bp, Homo sapiens
tgatttttttttgac

SEQ ID NO: 37755 - DNA, 15 bp, Homo sapiens
ctgatttttttttga

SEQ ID NO: 37756 - DNA, 15 bp, Homo sapiens
gctgatttttttttg

SEQ ID NO: 37757 - DNA, 15 bp, Homo sapiens
ggctgattttttttt

SEQ ID NO: 37758 - DNA, 15 bp, Homo sapiens
aggctgatttttttt

SEQ ID NO: 37759 - DNA, 15 bp, Homo sapiens
aaggctgattttttt

SEQ ID NO: 37760 - DNA, 15 bp, Homo sapiens
taaggctgatttttt

SEQ ID NO: 37761 - DNA, 15 bp, Homo sapiens
gtaaggctgattttt

SEQ ID NO: 37762 - DNA, 15 bp, Homo sapiens
agtaaggctgatttt

SEQ ID NO: 37763 - DNA, 15 bp, Homo sapiens
cagtaaggctgattt

SEQ ID NO: 37764 - DNA, 15 bp, Homo sapiens
acagtaaggctgatt

SEQ ID NO: 37765 - DNA, 15 bp, Homo sapiens
cacagtaaggctgat

SEQ ID NO: 37766 - DNA, 15 bp, Homo sapiens
tcacagtaaggctga

SEQ ID NO: 37767 - DNA, 15 bp, Homo sapiens
ttcacagtaaggctg

SEQ ID NO: 37768 - DNA, 15 bp, Homo sapiens
cttcacagtaaggct

SEQ ID NO: 37769 - DNA, 15 bp, Homo sapiens
gcttcacagtaaggc

SEQ ID NO: 37770 - DNA, 15 bp, Homo sapiens
ggcttcacagtaagg

SEQ ID NO: 37771 - DNA, 15 bp, Homo sapiens
aggcttcacagtaag

SEQ ID NO: 37772 - DNA, 15 bp, Homo sapiens
gaggcttcacagtaa

SEQ ID NO: 37773 - DNA, 15 bp, Homo sapiens
ggaggcttcacagta

SEQ ID NO: 37774 - DNA, 15 bp, Homo sapiens
tggaggcttcacagt

SEQ ID NO: 37775 - DNA, 15 bp, Homo sapiens
ttggaggcttcacag

SEQ ID NO: 37776 - DNA, 15 bp, Homo sapiens
cttggaggcttcaca

SEQ ID NO: 37777 - DNA, 15 bp, Homo sapiens
ccttggaggcttcac

SEQ ID NO: 37778 - DNA, 15 bp, Homo sapiens
gccttggaggcttca

SEQ ID NO: 37779 - DNA, 15 bp, Homo sapiens
agccttggaggcttc

SEQ ID NO: 37780 - DNA, 15 bp, Homo sapiens
cagccttggaggctt

SEQ ID NO: 37781 - DNA, 15 bp, Homo sapiens
gcagccttggaggct

SEQ ID NO: 37782 - DNA, 15 bp, Homo sapiens
agcagccttggaggc

SEQ ID NO: 37783 - DNA, 15 bp, Homo sapiens
gagcagccttggagg

SEQ ID NO: 37784 - DNA, 15 bp, Homo sapiens
cgagcagccttggag

SEQ ID NO: 37785 - DNA, 15 bp, Homo sapiens
gcgagcagccttgga

SEQ ID NO: 37786 - DNA, 15 bp, Homo sapiens
tgcgagcagccttgg

SEQ ID NO: 37787 - DNA, 15 bp, Homo sapiens
ctgcgagcagccttg

SEQ ID NO: 37788 - DNA, 15 bp, Homo sapiens
cctgcgagcagcctt

SEQ ID NO: 37789 - DNA, 15 bp, Homo sapiens
gcctgcgagcagcct

SEQ ID NO: 37790 - DNA, 15 bp, Homo sapiens
tgcctgcgagcagcc

SEQ ID NO: 37791 - DNA, 15 bp, Homo sapiens
ctgcctgcgagcagc

SEQ ID NO: 37792 - DNA, 15 bp, Homo sapiens
gctgcctgcgagcag

SEQ ID NO: 37793 - DNA, 15 bp, Homo sapiens
agctgcctgcgagca

SEQ ID NO: 37794 - DNA, 15 bp, Homo sapiens
cagctgcctgcgagc

SEQ ID NO: 37795 - DNA, 15 bp, Homo sapiens
acagctgcctgcgag

SEQ ID NO: 37796 - DNA, 15 bp, Homo sapiens
cacagctgcctgcga

SEQ ID NO: 37797 - DNA, 15 bp, Homo sapiens
ccacagctgcctgcg

SEQ ID NO: 37798 - DNA, 15 bp, Homo sapiens
gccacagctgcctgc

SEQ ID NO: 37799 - DNA, 15 bp, Homo sapiens
agccacagctgcctg

SEQ ID NO: 37800 - DNA, 15 bp, Homo sapiens
gagccacagctgcct

SEQ ID NO: 37801 - DNA, 15 bp, Homo sapiens
agagccacagctgcc

SEQ ID NO: 37802 - DNA, 15 bp, Homo sapiens
gagagccacagctgc

SEQ ID NO: 37803 - DNA, 15 bp, Homo sapiens
cgagagccacagctg

SEQ ID NO: 37804 - DNA, 15 bp, Homo sapiens
ccgagagccacagct

SEQ ID NO: 37805 - DNA, 15 bp, Homo sapiens
cccgagagccacagc

SEQ ID NO: 37806 - DNA, 15 bp, Homo sapiens
tcccgagagccacag

SEQ ID NO: 37807 - DNA, 15 bp, Homo sapiens
ttcccgagagccaca

SEQ ID NO: 37808 - DNA, 15 bp, Homo sapiens
cttcccgagagccac

SEQ ID NO: 37809 - DNA, 15 bp, Homo sapiens
ccttcccgagagcca

SEQ ID NO: 37810 - DNA, 15 bp, Homo sapiens
cccttcccgagagcc

SEQ ID NO: 37811 - DNA, 15 bp, Homo sapiens
tcccttcccgagagc

SEQ ID NO: 37812 - DNA, 15 bp, Homo sapiens
ctcccttcccgagag

SEQ ID NO: 37813 - DNA, 15 bp, Homo sapiens
cctcccttcccgaga

SEQ ID NO: 37814 - DNA, 15 bp, Homo sapiens
gcctcccttcccgag

SEQ ID NO: 37815 - DNA, 15 bp, Homo sapiens
agcctcccttcccga

SEQ ID NO: 37816 - DNA, 15 bp, Homo sapiens
cagcctcccttcccg

SEQ ID NO: 37817 - DNA, 15 bp, Homo sapiens
gcagcctcccttccc

SEQ ID NO: 37818 - DNA, 15 bp, Homo sapiens
agcagcctcccttcc

SEQ ID NO: 37819 - DNA, 15 bp, Homo sapiens
aagcagcctcccttc

SEQ ID NO: 37820 - DNA, 15 bp, Homo sapiens
aaagcagcctccctt

SEQ ID NO: 37821 - DNA, 15 bp, Homo sapiens
caaagcagcctccct

SEQ ID NO: 37822 - DNA, 15 bp, Homo sapiens
gcaaagcagcctccc

SEQ ID NO: 37823 - DNA, 15 bp, Homo sapiens
ggcaaagcagcctcc

SEQ ID NO: 37824 - DNA, 15 bp, Homo sapiens
gggcaaagcagcctc

SEQ ID NO: 37825 - DNA, 15 bp, Homo sapiens
tgggcaaagcagcct

SEQ ID NO: 37826 - DNA, 15 bp, Homo sapiens
ctgggcaaagcagcc

SEQ ID NO: 37827 - DNA, 15 bp, Homo sapiens
gctgggcaaagcagc

SEQ ID NO: 37828 - DNA, 15 bp, Homo sapiens
tgctgggcaaagcag

SEQ ID NO: 37829 - DNA, 15 bp, Homo sapiens
ctgctgggcaaagca

SEQ ID NO: 37830 - DNA, 15 bp, Homo sapiens
cctgctgggcaaagc

SEQ ID NO: 37831 - DNA, 15 bp, Homo sapiens
ccctgctgggcaaag

SEQ ID NO: 37832 - DNA, 15 bp, Homo sapiens
tccctgctgggcaaa

SEQ ID NO: 37833 - DNA, 15 bp, Homo sapiens
ttccctgctgggcaa

SEQ ID NO: 37834 - DNA, 15 bp, Homo sapiens
gttccctgctgggca

SEQ ID NO: 37835 - DNA, 15 bp, Homo sapiens
tgttccctgctgggc

SEQ ID NO: 37836 - DNA, 15 bp, Homo sapiens
atgttccctgctggg

SEQ ID NO: 37837 - DNA, 15 bp, Homo sapiens
aatgttccctgctgg

SEQ ID NO: 37838 - DNA, 15 bp, Homo sapiens
aaatgttccctgctg

SEQ ID NO: 37839 - DNA, 15 bp, Homo sapiens
caaatgttccctgct

SEQ ID NO: 37840 - DNA, 15 bp, Homo sapiens
ccaaatgttccctgc

SEQ ID NO: 37841 - DNA, 15 bp, Homo sapiens
cccaaatgttccctg

SEQ ID NO: 37842 - DNA, 15 bp, Homo sapiens
ccccaaatgttccct

SEQ ID NO: 37843 - DNA, 15 bp, Homo sapiens
gccccaaatgttccc

SEQ ID NO: 37844 - DNA, 15 bp, Homo sapiens
tgccccaaatgttcc

SEQ ID NO: 37845 - DNA, 15 bp, Homo sapiens
ctgccccaaatgttc

SEQ ID NO: 37846 - DNA, 15 bp, Homo sapiens
cctgccccaaatgtt

SEQ ID NO: 37847 - DNA, 15 bp, Homo sapiens
ccctgccccaaatgt

SEQ ID NO: 37848 - DNA, 15 bp, Homo sapiens
cccctgccccaaatg

SEQ ID NO: 37849 - DNA, 15 bp, Homo sapiens
ccccctgccccaaat

SEQ ID NO: 37850 - DNA, 15 bp, Homo sapiens
accccctgccccaaa

SEQ ID NO: 37851 - DNA, 15 bp, Homo sapiens
taccccctgccccaa

SEQ ID NO: 37852 - DNA, 15 bp, Homo sapiens
ttaccccctgcccca

SEQ ID NO: 37853 - DNA, 15 bp, Homo sapiens
tttaccccctgcccc

SEQ ID NO: 37854 - DNA, 15 bp, Homo sapiens
atttaccccctgccc

SEQ ID NO: 37855 - DNA, 15 bp, Homo sapiens
aatttaccccctgcc

SEQ ID NO: 37856 - DNA, 15 bp, Homo sapiens
aaatttaccccctgc

SEQ ID NO: 37857 - DNA, 15 bp, Homo sapiens
aaaatttaccccctg

SEQ ID NO: 37858 - DNA, 15 bp, Homo sapiens
caaaatttaccccct

SEQ ID NO: 37859 - DNA, 15 bp, Homo sapiens
gcaaaatttaccccc

SEQ ID NO: 37860 - DNA, 15 bp, Homo sapiens
ggcaaaatttacccc

SEQ ID NO: 37861 - DNA, 15 bp, Homo sapiens
tggcaaaatttaccc

SEQ ID NO: 37862 - DNA, 15 bp, Homo sapiens
ctggcaaaatttacc

SEQ ID NO: 37863 - DNA, 15 bp, Homo sapiens
actggcaaaatttac

SEQ ID NO: 37864 - DNA, 15 bp, Homo sapiens
aactggcaaaattta

SEQ ID NO: 37865 - DNA, 15 bp, Homo sapiens
aaactggcaaaattt

SEQ ID NO: 37866 - DNA, 15 bp, Homo sapiens
caaactggcaaaatt

SEQ ID NO: 37867 - DNA, 15 bp, Homo sapiens
tcaaactggcaaaat

SEQ ID NO: 37868 - DNA, 15 bp, Homo sapiens
ctcaaactggcaaaa

SEQ ID NO: 37869 - DNA, 15 bp, Homo sapiens
gctcaaactggcaaa

SEQ ID NO: 37870 - DNA, 15 bp, Homo sapiens
tgctcaaactggcaa

SEQ ID NO: 37871 - DNA, 15 bp, Homo sapiens
atgctcaaactggca

SEQ ID NO: 37872 - DNA, 15 bp, Homo sapiens
gatgctcaaactggc

SEQ ID NO: 37873 - DNA, 15 bp, Homo sapiens
tgatgctcaaactgg

SEQ ID NO: 37874 - DNA, 15 bp, Homo sapiens
atgatgctcaaactg

SEQ ID NO: 37875 - DNA, 15 bp, Homo sapiens
catgatgctcaaact

SEQ ID NO: 37876 - DNA, 15 bp, Homo sapiens
tcatgatgctcaaac

SEQ ID NO: 37877 - DNA, 15 bp, Homo sapiens
ctcatgatgctcaaa

SEQ ID NO: 37878 - DNA, 15 bp, Homo sapiens
cctcatgatgctcaa

SEQ ID NO: 37879 - DNA, 15 bp, Homo sapiens
acctcatgatgctca

SEQ ID NO: 37880 - DNA, 15 bp, Homo sapiens
cacctcatgatgctc

SEQ ID NO: 37881 - DNA, 15 bp, Homo sapiens
acacctcatgatgct

SEQ ID NO: 37882 - DNA, 15 bp, Homo sapiens
tacacctcatgatgc

SEQ ID NO: 37883 - DNA, 15 bp, Homo sapiens
ttacacctcatgatg

SEQ ID NO: 37884 - DNA, 15 bp, Homo sapiens
gttacacctcatgat

SEQ ID NO: 37885 - DNA, 15 bp, Homo sapiens
tgttacacctcatga

SEQ ID NO: 37886 - DNA, 15 bp, Homo sapiens
ttgttacacctcatg

SEQ ID NO: 37887 - DNA, 15 bp, Homo sapiens
cttgttacacctcat

SEQ ID NO: 37888 - DNA, 15 bp, Homo sapiens
tcttgttacacctca

SEQ ID NO: 37889 - DNA, 15 bp, Homo sapiens
ttcttgttacacctc

SEQ ID NO: 37890 - DNA, 15 bp, Homo sapiens
tttcttgttacacct

SEQ ID NO: 37891 - DNA, 15 bp, Homo sapiens
atttcttgttacacc

SEQ ID NO: 37892 - DNA, 15 bp, Homo sapiens
catttcttgttacac

SEQ ID NO: 37893 - DNA, 15 bp, Homo sapiens
ccatttcttgttaca

SEQ ID NO: 37894 - DNA, 15 bp, Homo sapiens
cccatttcttgttac

SEQ ID NO: 37895 - DNA, 15 bp, Homo sapiens
acccatttcttgtta

SEQ ID NO: 37896 - DNA, 15 bp, Homo sapiens
aacccatttcttgtt

SEQ ID NO: 37897 - DNA, 15 bp, Homo sapiens
caacccatttcttgt

SEQ ID NO: 37898 - DNA, 15 bp, Homo sapiens
tcaacccatttcttg

SEQ ID NO: 37899 - DNA, 15 bp, Homo sapiens
ttcaacccatttctt

SEQ ID NO: 37900 - DNA, 15 bp, Homo sapiens
attcaacccatttct

SEQ ID NO: 37901 - DNA, 15 bp, Homo sapiens
cattcaacccatttc

SEQ ID NO: 37902 - DNA, 15 bp, Homo sapiens
ccattcaacccattt

SEQ ID NO: 37903 - DNA, 15 bp, Homo sapiens
cccattcaacccatt

SEQ ID NO: 37904 - DNA, 15 bp, Homo sapiens
gcccattcaacccat

SEQ ID NO: 37905 - DNA, 15 bp, Homo sapiens
ggcccattcaaccca

SEQ ID NO: 37906 - DNA, 15 bp, Homo sapiens
tggcccattcaaccc

SEQ ID NO: 37907 - DNA, 15 bp, Homo sapiens
ttggcccattcaacc

SEQ ID NO: 37908 - DNA, 15 bp, Homo sapiens
tttggcccattcaac

SEQ ID NO: 37909 - DNA, 15 bp, Homo sapiens
atttggcccattcaa

SEQ ID NO: 37910 - DNA, 15 bp, Homo sapiens
catttggcccattca

SEQ ID NO: 37911 - DNA, 15 bp, Homo sapiens
gcatttggcccattc

SEQ ID NO: 37912 - DNA, 15 bp, Homo sapiens
tgcatttggcccatt

SEQ ID NO: 37913 - DNA, 15 bp, Homo sapiens
ttgcatttggcccat

SEQ ID NO: 37914 - DNA, 15 bp, Homo sapiens
cttgcatttggccca

SEQ ID NO: 37915 - DNA, 15 bp, Homo sapiens
ccttgcatttggccc

SEQ ID NO: 37916 - DNA, 15 bp, Homo sapiens
tccttgcatttggcc

SEQ ID NO: 37917 - DNA, 15 bp, Homo sapiens
ctccttgcatttggc

SEQ ID NO: 37918 - DNA, 15 bp, Homo sapiens
actccttgcatttgg

SEQ ID NO: 37919 - DNA, 15 bp, Homo sapiens
cactccttgcatttg

SEQ ID NO: 37920 - DNA, 15 bp, Homo sapiens
gcactccttgcattt

SEQ ID NO: 37921 - DNA, 15 bp, Homo sapiens
tgcactccttgcatt

SEQ ID NO: 37922 - DNA, 15 bp, Homo sapiens
atgcactccttgcat

SEQ ID NO: 37923 - DNA, 15 bp, Homo sapiens
gatgcactccttgca

SEQ ID NO: 37924 - DNA, 15 bp, Homo sapiens
agatgcactccttgc

SEQ ID NO: 37925 - DNA, 15 bp, Homo sapiens
gagatgcactccttg

SEQ ID NO: 37926 - DNA, 15 bp, Homo sapiens
agagatgcactcctt

SEQ ID NO: 37927 - DNA, 15 bp, Homo sapiens
cagagatgcactcct

SEQ ID NO: 37928 - DNA, 15 bp, Homo sapiens
ccagagatgcactcc

SEQ ID NO: 37929 - DNA, 15 bp, Homo sapiens
cccagagatgcactc

SEQ ID NO: 37930 - DNA, 15 bp, Homo sapiens
gcccagagatgcact

SEQ ID NO: 37931 - DNA, 15 bp, Homo sapiens
agcccagagatgcac

SEQ ID NO: 37932 - DNA, 15 bp, Homo sapiens
cagcccagagatgca

SEQ ID NO: 37933 - DNA, 15 bp, Homo sapiens
gcagcccagagatgc

SEQ ID NO: 37934 - DNA, 15 bp, Homo sapiens
tgcagcccagagatg

SEQ ID NO: 37935 - DNA, 15 bp, Homo sapiens
ttgcagcccagagat

SEQ ID NO: 37936 - DNA, 15 bp, Homo sapiens
tttgcagcccagaga

SEQ ID NO: 37937 - DNA, 15 bp, Homo sapiens
gtttgcagcccagag

SEQ ID NO: 37938 - DNA, 15 bp, Homo sapiens
agtttgcagcccaga

SEQ ID NO: 37939 - DNA, 15 bp, Homo sapiens
cagtttgcagcccag

SEQ ID NO: 37940 - DNA, 15 bp, Homo sapiens
tcagtttgcagccca

SEQ ID NO: 37941 - DNA, 15 bp, Homo sapiens
gtcagtttgcagccc

SEQ ID NO: 37942 - DNA, 15 bp, Homo sapiens
agtcagtttgcagcc

SEQ ID NO: 37943 - DNA, 15 bp, Homo sapiens
aagtcagtttgcagc

SEQ ID NO: 37944 - DNA, 15 bp, Homo sapiens
caagtcagtttgcag

SEQ ID NO: 37945 - DNA, 15 bp, Homo sapiens
tcaagtcagtttgca

SEQ ID NO: 37946 - DNA, 15 bp, Homo sapiens
ctcaagtcagtttgc

SEQ ID NO: 37947 - DNA, 15 bp, Homo sapiens
actcaagtcagtttg

SEQ ID NO: 37948 - DNA, 15 bp, Homo sapiens
cactcaagtcagttt

SEQ ID NO: 37949 - DNA, 15 bp, Homo sapiens
gcactcaagtcagtt

SEQ ID NO: 37950 - DNA, 15 bp, Homo sapiens
agcactcaagtcagt

SEQ ID NO: 37951 - DNA, 15 bp, Homo sapiens
cagcactcaagtcag

SEQ ID NO: 37952 - DNA, 15 bp, Homo sapiens
gcagcactcaagtca

SEQ ID NO: 37953 - DNA, 15 bp, Homo sapiens
tgcagcactcaagtc

SEQ ID NO: 37954 - DNA, 15 bp, Homo sapiens
gtgcagcactcaagt

SEQ ID NO: 37955 - DNA, 15 bp, Homo sapiens
agtgcagcactcaag

SEQ ID NO: 37956 - DNA, 15 bp, Homo sapiens
tagtgcagcactcaa

SEQ ID NO: 37957 - DNA, 15 bp, Homo sapiens
atagtgcagcactca

SEQ ID NO: 37958 - DNA, 15 bp, Homo sapiens
aatagtgcagcactc

SEQ ID NO: 37959 - DNA, 15 bp, Homo sapiens
caatagtgcagcact

SEQ ID NO: 37960 - DNA, 15 bp, Homo sapiens
gcaatagtgcagcac

SEQ ID NO: 37961 - DNA, 15 bp, Homo sapiens
agcaatagtgcagca

SEQ ID NO: 37962 - DNA, 15 bp, Homo sapiens
tagcaatagtgcagc

SEQ ID NO: 37963 - DNA, 15 bp, Homo sapiens
atagcaatagtgcag

SEQ ID NO: 37964 - DNA, 15 bp, Homo sapiens
aatagcaatagtgca

SEQ ID NO: 37965 - DNA, 15 bp, Homo sapiens
gaatagcaatagtgc

SEQ ID NO: 37966 - DNA, 15 bp, Homo sapiens
ggaatagcaatagtg

SEQ ID NO: 37967 - DNA, 15 bp, Homo sapiens
cggaatagcaatagt

SEQ ID NO: 37968 - DNA, 15 bp, Homo sapiens
acggaatagcaatag

SEQ ID NO: 37969 - DNA, 15 bp, Homo sapiens
cacggaatagcaata

SEQ ID NO: 37970 - DNA, 15 bp, Homo sapiens
gcacggaatagcaat

SEQ ID NO: 37971 - DNA, 15 bp, Homo sapiens
tgcacggaatagcaa

SEQ ID NO: 37972 - DNA, 15 bp, Homo sapiens
ttgcacggaatagca

SEQ ID NO: 37973 - DNA, 15 bp, Homo sapiens
tttgcacggaatagc

SEQ ID NO: 37974 - DNA, 15 bp, Homo sapiens
gtttgcacggaatag

SEQ ID NO: 37975 - DNA, 15 bp, Homo sapiens
tgtttgcacggaata

SEQ ID NO: 37976 - DNA, 15 bp, Homo sapiens
ttgtttgcacggaat

SEQ ID NO: 37977 - DNA, 15 bp, Homo sapiens
tttgtttgcacggaa

SEQ ID NO: 37978 - DNA, 15 bp, Homo sapiens
ttttgtttgcacgga

SEQ ID NO: 37979 - DNA, 15 bp, Homo sapiens
gttttgtttgcacgg

SEQ ID NO: 37980 - DNA, 15 bp, Homo sapiens
agttttgtttgcacg

SEQ ID NO: 37981 - DNA, 15 bp, Homo sapiens
gagttttgtttgcac

SEQ ID NO: 37982 - DNA, 15 bp, Homo sapiens
tgagttttgtttgca

SEQ ID NO: 37983 - DNA, 15 bp, Homo sapiens
ctgagttttgtttgc

SEQ ID NO: 37984 - DNA, 15 bp, Homo sapiens
gctgagttttgtttg

SEQ ID NO: 37985 - DNA, 15 bp, Homo sapiens
agctgagttttgttt

SEQ ID NO: 37986 - DNA, 15 bp, Homo sapiens
aagctgagttttgtt

SEQ ID NO: 37987 - DNA, 15 bp, Homo sapiens
aaagctgagttttgt

SEQ ID NO: 37988 - DNA, 15 bp, Homo sapiens
aaaagctgagttttg

SEQ ID NO: 37989 - DNA, 15 bp, Homo sapiens
gaaaagctgagtttt

SEQ ID NO: 37990 - DNA, 15 bp, Homo sapiens
ggaaaagctgagttt

SEQ ID NO: 37991 - DNA, 15 bp, Homo sapiens
aggaaaagctgagtt

SEQ ID NO: 37992 - DNA, 15 bp, Homo sapiens
caggaaaagctgagt

SEQ ID NO: 37993 - DNA, 15 bp, Homo sapiens
tcaggaaaagctgag

SEQ ID NO: 37994 - DNA, 15 bp, Homo sapiens
gtcaggaaaagctga

SEQ ID NO: 37995 - DNA, 15 bp, Homo sapiens
agtcaggaaaagctg

SEQ ID NO: 37996 - DNA, 15 bp, Homo sapiens
gagtcaggaaaagct

SEQ ID NO: 37997 - DNA, 15 bp, Homo sapiens
tgagtcaggaaaagc

SEQ ID NO: 37998 - DNA, 15 bp, Homo sapiens
ctgagtcaggaaaag

SEQ ID NO: 37999 - DNA, 15 bp, Homo sapiens
actgagtcaggaaaa

SEQ ID NO: 38000 - DNA, 15 bp, Homo sapiens
aactgagtcaggaaa

SEQ ID NO: 38001 - DNA, 15 bp, Homo sapiens
gaactgagtcaggaa

SEQ ID NO: 38002 - DNA, 15 bp, Homo sapiens
ggaactgagtcagga

SEQ ID NO: 38003 - DNA, 15 bp, Homo sapiens
aggaactgagtcagg

SEQ ID NO: 38004 - DNA, 15 bp, Homo sapiens
aaggaactgagtcag

SEQ ID NO: 38005 - DNA, 15 bp, Homo sapiens
caaggaactgagtca

SEQ ID NO: 38006 - DNA, 15 bp, Homo sapiens
tcaaggaactgagtc

SEQ ID NO: 38007 - DNA, 15 bp, Homo sapiens
gtcaaggaactgagt

SEQ ID NO: 38008 - DNA, 15 bp, Homo sapiens
agtcaaggaactgag

SEQ ID NO: 38009 - DNA, 15 bp, Homo sapiens
aagtcaaggaactga

SEQ ID NO: 38010 - DNA, 15 bp, Homo sapiens
taagtcaaggaactg

SEQ ID NO: 38011 - DNA, 15 bp, Homo sapiens
ctaagtcaaggaact

SEQ ID NO: 38012 - DNA, 15 bp, Homo sapiens
actaagtcaaggaac

SEQ ID NO: 38013 - DNA, 15 bp, Homo sapiens
cactaagtcaaggaa

SEQ ID NO: 38014 - DNA, 15 bp, Homo sapiens
ccactaagtcaagga

SEQ ID NO: 38015 - DNA, 15 bp, Homo sapiens
gccactaagtcaagg

SEQ ID NO: 38016 - DNA, 15 bp, Homo sapiens
ggccactaagtcaag

SEQ ID NO: 38017 - DNA, 15 bp, Homo sapiens
aggccactaagtcaa

SEQ ID NO: 38018 - DNA, 15 bp, Homo sapiens
aaggccactaagtca

SEQ ID NO: 38019 - DNA, 15 bp, Homo sapiens
aaaggccactaagtc

SEQ ID NO: 38020 - DNA, 15 bp, Homo sapiens
taaaggccactaagt

SEQ ID NO: 38021 - DNA, 15 bp, Homo sapiens
gtaaaggccactaag

SEQ ID NO: 38022 - DNA, 15 bp, Homo sapiens
tgtaaaggccactaa

SEQ ID NO: 38023 - DNA, 15 bp, Homo sapiens
ttgtaaaggccacta

SEQ ID NO: 38024 - DNA, 15 bp, Homo sapiens
tttgtaaaggccact

SEQ ID NO: 38025 - DNA, 15 bp, Homo sapiens
ttttgtaaaggccac

SEQ ID NO: 38026 - DNA, 15 bp, Homo sapiens
tttttgtaaaggcca

SEQ ID NO: 38027 - DNA, 15 bp, Homo sapiens
ttttttgtaaaggcc

SEQ ID NO: 38028 - DNA, 15 bp, Homo sapiens
tttttttgtaaaggc

SEQ ID NO: 38029 - DNA, 15 bp, Homo sapiens
ctttttttgtaaagg

SEQ ID NO: 38030 - DNA, 15 bp, Homo sapiens
caactttttttgtaa

SEQ ID NO: 38031 - DNA, 15 bp, Homo sapiens
tcaactttttttgta

SEQ ID NO: 38032 - DNA, 15 bp, Homo sapiens
ctcaactttttttgt

SEQ ID NO: 38033 - DNA, 15 bp, Homo sapiens
actcaactttttttg

SEQ ID NO: 38034 - DNA, 15 bp, Homo sapiens
tactcaacttttttt

SEQ ID NO: 38035 - DNA, 15 bp, Homo sapiens
ctactcaactttttt

SEQ ID NO: 38036 - DNA, 15 bp, Homo sapiens
actactcaacttttt

SEQ ID NO: 38037 - DNA, 15 bp, Homo sapiens
cactactcaactttt

SEQ ID NO: 38038 - DNA, 15 bp, Homo sapiens
acactactcaacttt

SEQ ID NO: 38039 - DNA, 15 bp, Homo sapiens
cacactactcaactt

SEQ ID NO: 38040 - DNA, 15 bp, Homo sapiens
acacactactcaact

SEQ ID NO: 38041 - DNA, 15 bp, Homo sapiens
cacacactactcaac

SEQ ID NO: 38042 - DNA, 15 bp, Homo sapiens
ccacacactactcaa

SEQ ID NO: 38043 - DNA, 15 bp, Homo sapiens
gccacacactactca

SEQ ID NO: 38044 - DNA, 15 bp, Homo sapiens
ggccacacactactc

SEQ ID NO: 38045 - DNA, 15 bp, Homo sapiens
aggccacacactact

SEQ ID NO: 38046 - DNA, 15 bp, Homo sapiens
caggccacacactac

SEQ ID NO: 38047 - DNA, 15 bp, Homo sapiens
gcaggccacacacta

SEQ ID NO: 38048 - DNA, 15 bp, Homo sapiens
agcaggccacacact

SEQ ID NO: 38049 - DNA, 15 bp, Homo sapiens
cagcaggccacacac

SEQ ID NO: 38050 - DNA, 15 bp, Homo sapiens
acagcaggccacaca

SEQ ID NO: 38051 - DNA, 15 bp, Homo sapiens
gacagcaggccacac

SEQ ID NO: 38052 - DNA, 15 bp, Homo sapiens
cgacagcaggccaca

SEQ ID NO: 38053 - DNA, 15 bp, Homo sapiens
gcgacagcaggccac

SEQ ID NO: 38054 - DNA, 15 bp, Homo sapiens
tgcgacagcaggcca

SEQ ID NO: 38055 - DNA, 15 bp, Homo sapiens
gtgcgacagcaggcc

SEQ ID NO: 38056 - DNA, 15 bp, Homo sapiens
tgtgcgacagcaggc

SEQ ID NO: 38057 - DNA, 15 bp, Homo sapiens
ctgtgcgacagcagg

SEQ ID NO: 38058 - DNA, 15 bp, Homo sapiens
gctgtgcgacagcag

SEQ ID NO: 38059 - DNA, 15 bp, Homo sapiens
ggctgtgcgacagca

SEQ ID NO: 38060 - DNA, 15 bp, Homo sapiens
gggctgtgcgacagc

SEQ ID NO: 38061 - DNA, 15 bp, Homo sapiens
ggggctgtgcgacag

SEQ ID NO: 38062 - DNA, 15 bp, Homo sapiens
aggggctgtgcgaca

SEQ ID NO: 38063 - DNA, 15 bp, Homo sapiens
taggggctgtgcgac

SEQ ID NO: 38064 - DNA, 15 bp, Homo sapiens
ctaggggctgtgcga

SEQ ID NO: 38065 - DNA, 15 bp, Homo sapiens
actaggggctgtgcg

SEQ ID NO: 38066 - DNA, 15 bp, Homo sapiens
aactaggggctgtgc

SEQ ID NO: 38067 - DNA, 15 bp, Homo sapiens
taactaggggctgtg

SEQ ID NO: 38068 - DNA, 15 bp, Homo sapiens
ctaactaggggctgt

SEQ ID NO: 38069 - DNA, 15 bp, Homo sapiens
gctaactaggggctg

SEQ ID NO: 38070 - DNA, 15 bp, Homo sapiens
agctaactaggggct

SEQ ID NO: 38071 - DNA, 15 bp, Homo sapiens
aagctaactaggggc

SEQ ID NO: 38072 - DNA, 15 bp, Homo sapiens
gaagctaactagggg

SEQ ID NO: 38073 - DNA, 15 bp, Homo sapiens
tgaagctaactaggg

SEQ ID NO: 38074 - DNA, 15 bp, Homo sapiens
atgaagctaactagg

SEQ ID NO: 38075 - DNA, 15 bp, Homo sapiens
catgaagctaactag

SEQ ID NO: 38076 - DNA, 15 bp, Homo sapiens
ccatgaagctaacta

SEQ ID NO: 38077 - DNA, 15 bp, Homo sapiens
accatgaagctaact

SEQ ID NO: 38078 - DNA, 15 bp, Homo sapiens
aaccatgaagctaac

SEQ ID NO: 38079 - DNA, 15 bp, Homo sapiens
aaaccatgaagctaa

SEQ ID NO: 38080 - DNA, 15 bp, Homo sapiens
gaaaccatgaagcta

SEQ ID NO: 38081 - DNA, 15 bp, Homo sapiens
agaaaccatgaagct

SEQ ID NO: 38082 - DNA, 15 bp, Homo sapiens
gagaaaccatgaagc

SEQ ID NO: 38083 - DNA, 15 bp, Homo sapiens
tgagaaaccatgaag

SEQ ID NO: 38084 - DNA, 15 bp, Homo sapiens
ctgagaaaccatgaa

SEQ ID NO: 38085 - DNA, 15 bp, Homo sapiens
gctgagaaaccatga

SEQ ID NO: 38086 - DNA, 15 bp, Homo sapiens
agctgagaaaccatg

SEQ ID NO: 38087 - DNA, 15 bp, Homo sapiens
aagctgagaaaccat

SEQ ID NO: 38088 - DNA, 15 bp, Homo sapiens
gaagctgagaaacca

SEQ ID NO: 38089 - DNA, 15 bp, Homo sapiens
tgaagctgagaaacc

SEQ ID NO: 38090 - DNA, 15 bp, Homo sapiens
ctgaagctgagaaac

SEQ ID NO: 38091 - DNA, 15 bp, Homo sapiens
tctgaagctgagaaa

SEQ ID NO: 38092 - DNA, 15 bp, Homo sapiens
gtctgaagctgagaa

SEQ ID NO: 38093 - DNA, 15 bp, Homo sapiens
ggtctgaagctgaga

SEQ ID NO: 38094 - DNA, 15 bp, Homo sapiens
gggtctgaagctgag

SEQ ID NO: 38095 - DNA, 15 bp, Homo sapiens
ggggtctgaagctga

SEQ ID NO: 38096 - DNA, 15 bp, Homo sapiens
aggggtctgaagctg

SEQ ID NO: 38097 - DNA, 15 bp, Homo sapiens
gaggggtctgaagct

SEQ ID NO: 38098 - DNA, 15 bp, Homo sapiens
ggaggggtctgaagc

SEQ ID NO: 38099 - DNA, 15 bp, Homo sapiens
tggaggggtctgaag

SEQ ID NO: 38100 - DNA, 15 bp, Homo sapiens
ctggaggggtctgaa

SEQ ID NO: 38101 - DNA, 15 bp, Homo sapiens
gctggaggggtctga

SEQ ID NO: 38102 - DNA, 15 bp, Homo sapiens
ggctggaggggtctg

SEQ ID NO: 38103 - DNA, 15 bp, Homo sapiens
gggctggaggggtct

SEQ ID NO: 38104 - DNA, 15 bp, Homo sapiens
tgggctggaggggtc

SEQ ID NO: 38105 - DNA, 15 bp, Homo sapiens
gtgggctggaggggt

SEQ ID NO: 38106 - DNA, 15 bp, Homo sapiens
tgtgggctggagggg

SEQ ID NO: 38107 - DNA, 15 bp, Homo sapiens
ctgtgggctggaggg

SEQ ID NO: 38108 - DNA, 15 bp, Homo sapiens
tctgtgggctggagg

SEQ ID NO: 38109 - DNA, 15 bp, Homo sapiens
ctctgtgggctggag

SEQ ID NO: 38110 - DNA, 15 bp, Homo sapiens
cctctgtgggctgga

SEQ ID NO: 38111 - DNA, 15 bp, Homo sapiens
tcctctgtgggctgg

SEQ ID NO: 38112 - DNA, 15 bp, Homo sapiens
ctcctctgtgggctg

SEQ ID NO: 38113 - DNA, 15 bp, Homo sapiens
gctcctctgtgggct

SEQ ID NO: 38114 - DNA, 15 bp, Homo sapiens
ggctcctctgtgggc

SEQ ID NO: 38115 - DNA, 15 bp, Homo sapiens
gggctcctctgtggg

SEQ ID NO: 38116 - DNA, 15 bp, Homo sapiens
tgggctcctctgtgg

SEQ ID NO: 38117 - DNA, 15 bp, Homo sapiens
atgggctcctctgtg

SEQ ID NO: 38118 - DNA, 15 bp, Homo sapiens
catgggctcctctgt

SEQ ID NO: 38119 - DNA, 15 bp, Homo sapiens
ccatgggctcctctg

SEQ ID NO: 38120 - DNA, 15 bp, Homo sapiens
tccatgggctcctct

SEQ ID NO: 38121 - DNA, 15 bp, Homo sapiens
ctccatgggctcctc

SEQ ID NO: 38122 - DNA, 15 bp, Homo sapiens
cctccatgggctcct

SEQ ID NO: 38123 - DNA, 15 bp, Homo sapiens
ccctccatgggctcc

SEQ ID NO: 38124 - DNA, 15 bp, Homo sapiens
tccctccatgggctc

SEQ ID NO: 38125 - DNA, 15 bp, Homo sapiens
gtccctccatgggct

SEQ ID NO: 38126 - DNA, 15 bp, Homo sapiens
ggtccctccatgggc

SEQ ID NO: 38127 - DNA, 15 bp, Homo sapiens
gggtccctccatggg

SEQ ID NO: 38128 - DNA, 15 bp, Homo sapiens
tgggtccctccatgg

SEQ ID NO: 38129 - DNA, 15 bp, Homo sapiens
gtgggtccctccatg

SEQ ID NO: 38130 - DNA, 15 bp, Homo sapiens
agtgggtccctccat

SEQ ID NO: 38131 - DNA, 15 bp, Homo sapiens
aagtgggtccctcca

SEQ ID NO: 38132 - DNA, 15 bp, Homo sapiens
gaagtgggtccctcc

SEQ ID NO: 38133 - DNA, 15 bp, Homo sapiens
ggaagtgggtccctc

SEQ ID NO: 38134 - DNA, 15 bp, Homo sapiens
gggaagtgggtccct

SEQ ID NO: 38135 - DNA, 15 bp, Homo sapiens
agggaagtgggtccc

SEQ ID NO: 38136 - DNA, 15 bp, Homo sapiens
aagggaagtgggtcc

SEQ ID NO: 38137 - DNA, 15 bp, Homo sapiens
caagggaagtgggtc

SEQ ID NO: 38138 - DNA, 15 bp, Homo sapiens
ccaagggaagtgggt

SEQ ID NO: 38139 - DNA, 15 bp, Homo sapiens
accaagggaagtggg

SEQ ID NO: 38140 - DNA, 15 bp, Homo sapiens
gaccaagggaagtgg

SEQ ID NO: 38141 - DNA, 15 bp, Homo sapiens
ggaccaagggaagtg

SEQ ID NO: 38142 - DNA, 15 bp, Homo sapiens
tggaccaagggaagt

SEQ ID NO: 38143 - DNA, 15 bp, Homo sapiens
ctggaccaagggaag

SEQ ID NO: 38144 - DNA, 15 bp, Homo sapiens
tctggaccaagggaa

SEQ ID NO: 38145 - DNA, 15 bp, Homo sapiens
gtctggaccaaggga

SEQ ID NO: 38146 - DNA, 15 bp, Homo sapiens
tgtctggaccaaggg

SEQ ID NO: 38147 - DNA, 15 bp, Homo sapiens
ctgtctggaccaagg

SEQ ID NO: 38148 - DNA, 15 bp, Homo sapiens
gctgtctggaccaag

SEQ ID NO: 38149 - DNA, 15 bp, Homo sapiens
agctgtctggaccaa

SEQ ID NO: 38150 - DNA, 15 bp, Homo sapiens
cagctgtctggacca

SEQ ID NO: 38151 - DNA, 15 bp, Homo sapiens
ccagctgtctggacc

SEQ ID NO: 38152 - DNA, 15 bp, Homo sapiens
cccagctgtctggac

SEQ ID NO: 38153 - DNA, 15 bp, Homo sapiens
tcccagctgtctgga

SEQ ID NO: 38154 - DNA, 15 bp, Homo sapiens
ctcccagctgtctgg

SEQ ID NO: 38155 - DNA, 15 bp, Homo sapiens
actcccagctgtctg

SEQ ID NO: 38156 - DNA, 15 bp, Homo sapiens
cactcccagctgtct

SEQ ID NO: 38157 - DNA, 15 bp, Homo sapiens
ccactcccagctgtc

SEQ ID NO: 38158 - DNA, 15 bp, Homo sapiens
cccactcccagctgt

SEQ ID NO: 38159 - DNA, 15 bp, Homo sapiens
acccactcccagctg

SEQ ID NO: 38160 - DNA, 15 bp, Homo sapiens
aacccactcccagct

SEQ ID NO: 38161 - DNA, 15 bp, Homo sapiens
taacccactcccagc

SEQ ID NO: 38162 - DNA, 15 bp, Homo sapiens
ctaacccactcccag

SEQ ID NO: 38163 - DNA, 15 bp, Homo sapiens
cctaacccactccca

SEQ ID NO: 38164 - DNA, 15 bp, Homo sapiens
gcctaacccactccc

SEQ ID NO: 38165 - DNA, 15 bp, Homo sapiens
ggcctaacccactcc

SEQ ID NO: 38166 - DNA, 15 bp, Homo sapiens
gggcctaacccactc

SEQ ID NO: 38167 - DNA, 15 bp, Homo sapiens
tgggcctaacccact

SEQ ID NO: 38168 - DNA, 15 bp, Homo sapiens
gtgggcctaacccac

SEQ ID NO: 38169 - DNA, 15 bp, Homo sapiens
agtgggcctaaccca

SEQ ID NO: 38170 - DNA, 15 bp, Homo sapiens
cagtgggcctaaccc

SEQ ID NO: 38171 - DNA, 15 bp, Homo sapiens
gcagtgggcctaacc

SEQ ID NO: 38172 - DNA, 15 bp, Homo sapiens
agcagtgggcctaac

SEQ ID NO: 38173 - DNA, 15 bp, Homo sapiens
cagcagtgggcctaa

SEQ ID NO: 38174 - DNA, 15 bp, Homo sapiens
acagcagtgggccta

SEQ ID NO: 38175 - DNA, 15 bp, Homo sapiens
aacagcagtgggcct

SEQ ID NO: 38176 - DNA, 15 bp, Homo sapiens
aaacagcagtgggcc

SEQ ID NO: 38177 - DNA, 15 bp, Homo sapiens
aaaacagcagtgggc

SEQ ID NO: 38178 - DNA, 15 bp, Homo sapiens
caaaacagcagtggg

SEQ ID NO: 38179 - DNA, 15 bp, Homo sapiens
tcaaaacagcagtgg

SEQ ID NO: 38180 - DNA, 15 bp, Homo sapiens
ctcaaaacagcagtg

SEQ ID NO: 38181 - DNA, 15 bp, Homo sapiens
gctcaaaacagcagt

SEQ ID NO: 38182 - DNA, 15 bp, Homo sapiens
tgctcaaaacagcag

SEQ ID NO: 38183 - DNA, 15 bp, Homo sapiens
ctgctcaaaacagca

SEQ ID NO: 38184 - DNA, 15 bp, Homo sapiens
cctgctcaaaacagc

SEQ ID NO: 38185 - DNA, 15 bp, Homo sapiens
ccctgctcaaaacag

SEQ ID NO: 38186 - DNA, 15 bp, Homo sapiens
gccctgctcaaaaca

SEQ ID NO: 38187 - DNA, 15 bp, Homo sapiens
ggccctgctcaaaac

SEQ ID NO: 38188 - DNA, 15 bp, Homo sapiens
tggccctgctcaaaa

SEQ ID NO: 38189 - DNA, 15 bp, Homo sapiens
gtggccctgctcaaa

SEQ ID NO: 38190 - DNA, 15 bp, Homo sapiens
agtggccctgctcaa

SEQ ID NO: 38191 - DNA, 15 bp, Homo sapiens
aagtggccctgctca

SEQ ID NO: 38192 - DNA, 15 bp, Homo sapiens
caagtggccctgctc

SEQ ID NO: 38193 - DNA, 15 bp, Homo sapiens
gcaagtggccctgct

SEQ ID NO: 38194 - DNA, 15 bp, Homo sapiens
agcaagtggccctgc

SEQ ID NO: 38195 - DNA, 15 bp, Homo sapiens
gagcaagtggccctg

SEQ ID NO: 38196 - DNA, 15 bp, Homo sapiens
ggagcaagtggccct

SEQ ID NO: 38197 - DNA, 15 bp, Homo sapiens
tggagcaagtggccc

SEQ ID NO: 38198 - DNA, 15 bp, Homo sapiens
atggagcaagtggcc

SEQ ID NO: 38199 - DNA, 15 bp, Homo sapiens
aatggagcaagtggc

SEQ ID NO: 38200 - DNA, 15 bp, Homo sapiens
aaatggagcaagtgg

SEQ ID NO: 38201 - DNA, 15 bp, Homo sapiens
gaaatggagcaagtg

SEQ ID NO: 38202 - DNA, 15 bp, Homo sapiens
tgaaatggagcaagt

SEQ ID NO: 38203 - DNA, 15 bp, Homo sapiens
gtgaaatggagcaag

SEQ ID NO: 38204 - DNA, 15 bp, Homo sapiens
agtgaaatggagcaa

SEQ ID NO: 38205 - DNA, 15 bp, Homo sapiens
cagtgaaatggagca

SEQ ID NO: 38206 - DNA, 15 bp, Homo sapiens
tcagtgaaatggagc

SEQ ID NO: 38207 - DNA, 15 bp, Homo sapiens
ttcagtgaaatggag

SEQ ID NO: 38208 - DNA, 15 bp, Homo sapiens
cttcagtgaaatgga

SEQ ID NO: 38209 - DNA, 15 bp, Homo sapiens
ccttcagtgaaatgg

SEQ ID NO: 38210 - DNA, 15 bp, Homo sapiens
gccttcagtgaaatg

SEQ ID NO: 38211 - DNA, 15 bp, Homo sapiens
agccttcagtgaaat

SEQ ID NO: 38212 - DNA, 15 bp, Homo sapiens
aagccttcagtgaaa

SEQ ID NO: 38213 - DNA, 15 bp, Homo sapiens
aaagccttcagtgaa

SEQ ID NO: 38214 - DNA, 15 bp, Homo sapiens
caaagccttcagtga

SEQ ID NO: 38215 - DNA, 15 bp, Homo sapiens
gcaaagccttcagtg

SEQ ID NO: 38216 - DNA, 15 bp, Homo sapiens
agcaaagccttcagt

SEQ ID NO: 38217 - DNA, 15 bp, Homo sapiens
cagcaaagccttcag

SEQ ID NO: 38218 - DNA, 15 bp, Homo sapiens
ccagcaaagccttca

SEQ ID NO: 38219 - DNA, 15 bp, Homo sapiens
cccagcaaagccttc

SEQ ID NO: 38220 - DNA, 15 bp, Homo sapiens
acccagcaaagcctt

SEQ ID NO: 38221 - DNA, 15 bp, Homo sapiens
cacccagcaaagcct

SEQ ID NO: 38222 - DNA, 15 bp, Homo sapiens
tcacccagcaaagcc

SEQ ID NO: 38223 - DNA, 15 bp, Homo sapiens
ttcacccagcaaagc

SEQ ID NO: 38224 - DNA, 15 bp, Homo sapiens
tttcacccagcaaag

SEQ ID NO: 38225 - DNA, 15 bp, Homo sapiens
ttttcacccagcaaa

SEQ ID NO: 38226 - DNA, 15 bp, Homo sapiens
gttttcacccagcaa

SEQ ID NO: 38227 - DNA, 15 bp, Homo sapiens
tgttttcacccagca

SEQ ID NO: 38228 - DNA, 15 bp, Homo sapiens
gtgttttcacccagc

SEQ ID NO: 38229 - DNA, 15 bp, Homo sapiens
agtgttttcacccag

SEQ ID NO: 38230 - DNA, 15 bp, Homo sapiens
aagtgttttcaccca

SEQ ID NO: 38231 - DNA, 15 bp, Homo sapiens
gaagtgttttcaccc

SEQ ID NO: 38232 - DNA, 15 bp, Homo sapiens
tgaagtgttttcacc

SEQ ID NO: 38233 - DNA, 15 bp, Homo sapiens
ctgaagtgttttcac

SEQ ID NO: 38234 - DNA, 15 bp, Homo sapiens
gctgaagtgttttca

SEQ ID NO: 38235 - DNA, 15 bp, Homo sapiens
tgctgaagtgttttc

SEQ ID NO: 38236 - DNA, 15 bp, Homo sapiens
atgctgaagtgtttt

SEQ ID NO: 38237 - DNA, 15 bp, Homo sapiens
gatgctgaagtgttt

SEQ ID NO: 38238 - DNA, 15 bp, Homo sapiens
agatgctgaagtgtt

SEQ ID NO: 38239 - DNA, 15 bp, Homo sapiens
gagatgctgaagtgt

SEQ ID NO: 38240 - DNA, 15 bp, Homo sapiens
ggagatgctgaagtg

SEQ ID NO: 38241 - DNA, 15 bp, Homo sapiens
aggagatgctgaagt

SEQ ID NO: 38242 - DNA, 15 bp, Homo sapiens
gaggagatgctgaag

SEQ ID NO: 38243 - DNA, 15 bp, Homo sapiens
ggaggagatgctgaa

SEQ ID NO: 38244 - DNA, 15 bp, Homo sapiens
aggaggagatgctga

SEQ ID NO: 38245 - DNA, 15 bp, Homo sapiens
gaggaggagatgctg

SEQ ID NO: 38246 - DNA, 15 bp, Homo sapiens
tgaggaggagatgct

SEQ ID NO: 38247 - DNA, 15 bp, Homo sapiens
ctgaggaggagatgc

SEQ ID NO: 38248 - DNA, 15 bp, Homo sapiens
cctgaggaggagatg

SEQ ID NO: 38249 - DNA, 15 bp, Homo sapiens
acctgaggaggagat

SEQ ID NO: 38250 - DNA, 15 bp, Homo sapiens
gacctgaggaggaga

SEQ ID NO: 38251 - DNA, 15 bp, Homo sapiens
tgacctgaggaggag

SEQ ID NO: 38252 - DNA, 15 bp, Homo sapiens
ttgacctgaggagga

SEQ ID NO: 38253 - DNA, 15 bp, Homo sapiens
gttgacctgaggagg

SEQ ID NO: 38254 - DNA, 15 bp, Homo sapiens
ggttgacctgaggag

SEQ ID NO: 38255 - DNA, 15 bp, Homo sapiens
gggttgacctgagga

SEQ ID NO: 38256 - DNA, 15 bp, Homo sapiens
tgggttgacctgagg

SEQ ID NO: 38257 - DNA, 15 bp, Homo sapiens
atgggttgacctgag

SEQ ID NO: 38258 - DNA, 15 bp, Homo sapiens
tatgggttgacctga

SEQ ID NO: 38259 - DNA, 15 bp, Homo sapiens
ttatgggttgacctg

SEQ ID NO: 38260 - DNA, 15 bp, Homo sapiens
tttatgggttgacct

SEQ ID NO: 38261 - DNA, 15 bp, Homo sapiens
ctttatgggttgacc

SEQ ID NO: 38262 - DNA, 15 bp, Homo sapiens
tctttatgggttgac

SEQ ID NO: 38263 - DNA, 15 bp, Homo sapiens
gtctttatgggttga

SEQ ID NO: 38264 - DNA, 15 bp, Homo sapiens
ggtctttatgggttg

SEQ ID NO: 38265 - DNA, 15 bp, Homo sapiens
tggtctttatgggtt

SEQ ID NO: 38266 - DNA, 15 bp, Homo sapiens
ctggtctttatgggt

SEQ ID NO: 38267 - DNA, 15 bp, Homo sapiens
cctggtctttatggg

SEQ ID NO: 38268 - DNA, 15 bp, Homo sapiens
acctggtctttatgg

SEQ ID NO: 38269 - DNA, 15 bp, Homo sapiens
gacctggtctttatg

SEQ ID NO: 38270 - DNA, 15 bp, Homo sapiens
ggacctggtctttat

SEQ ID NO: 38271 - DNA, 15 bp, Homo sapiens
tggacctggtcttta

SEQ ID NO: 38272 - DNA, 15 bp, Homo sapiens
ctggacctggtcttt

SEQ ID NO: 38273 - DNA, 15 bp, Homo sapiens
gctggacctggtctt

SEQ ID NO: 38274 - DNA, 15 bp, Homo sapiens
tgctggacctggtct

SEQ ID NO: 38275 - DNA, 15 bp, Homo sapiens
gtgctggacctggtc

SEQ ID NO: 38276 - DNA, 15 bp, Homo sapiens
ggtgctggacctggt

SEQ ID NO: 38277 - DNA, 15 bp, Homo sapiens
cggtgctggacctgg

SEQ ID NO: 38278 - DNA, 15 bp, Homo sapiens
acggtgctggacctg

SEQ ID NO: 38279 - DNA, 15 bp, Homo sapiens
cacggtgctggacct

SEQ ID NO: 38280 - DNA, 15 bp, Homo sapiens
ccacggtgctggacc

SEQ ID NO: 38281 - DNA, 15 bp, Homo sapiens
accacggtgctggac

SEQ ID NO: 38282 - DNA, 15 bp, Homo sapiens
gaccacggtgctgga

SEQ ID NO: 38283 - DNA, 15 bp, Homo sapiens
agaccacggtgctgg

SEQ ID NO: 38284 - DNA, 15 bp, Homo sapiens
aagaccacggtgctg

SEQ ID NO: 38285 - DNA, 15 bp, Homo sapiens
caagaccacggtgct

SEQ ID NO: 38286 - DNA, 15 bp, Homo sapiens
ccaagaccacggtgc

SEQ ID NO: 38287 - DNA, 15 bp, Homo sapiens
gccaagaccacggtg

SEQ ID NO: 38288 - DNA, 15 bp, Homo sapiens
tgccaagaccacggt

SEQ ID NO: 38289 - DNA, 15 bp, Homo sapiens
gtgccaagaccacgg

SEQ ID NO: 38290 - DNA, 15 bp, Homo sapiens
tgtgccaagaccacg

SEQ ID NO: 38291 - DNA, 15 bp, Homo sapiens
atgtgccaagaccac

SEQ ID NO: 38292 - DNA, 15 bp, Homo sapiens
gatgtgccaagacca

SEQ ID NO: 38293 - DNA, 15 bp, Homo sapiens
ggatgtgccaagacc

SEQ ID NO: 38294 - DNA, 15 bp, Homo sapiens
gggatgtgccaagac

SEQ ID NO: 38295 - DNA, 15 bp, Homo sapiens
agggatgtgccaaga

SEQ ID NO: 38296 - DNA, 15 bp, Homo sapiens
cagggatgtgccaag

SEQ ID NO: 38297 - DNA, 15 bp, Homo sapiens
ccagggatgtgccaa

SEQ ID NO: 38298 - DNA, 15 bp, Homo sapiens
gccagggatgtgcca

SEQ ID NO: 38299 - DNA, 15 bp, Homo sapiens
ggccagggatgtgcc

SEQ ID NO: 38300 - DNA, 15 bp, Homo sapiens
aggccagggatgtgc

SEQ ID NO: 38301 - DNA, 15 bp, Homo sapiens
gaggccagggatgtg

SEQ ID NO: 38302 - DNA, 15 bp, Homo sapiens
tgaggccagggatgt

SEQ ID NO: 38303 - DNA, 15 bp, Homo sapiens
ctgaggccagggatg

SEQ ID NO: 38304 - DNA, 15 bp, Homo sapiens
cctgaggccagggat

SEQ ID NO: 38305 - DNA, 15 bp, Homo sapiens
gcctgaggccaggga

SEQ ID NO: 38306 - DNA, 15 bp, Homo sapiens
ggcctgaggccaggg

SEQ ID NO: 38307 - DNA, 15 bp, Homo sapiens
gggcctgaggccagg

SEQ ID NO: 38308 - DNA, 15 bp, Homo sapiens
agggcctgaggccag

SEQ ID NO: 38309 - DNA, 15 bp, Homo sapiens
gagggcctgaggcca

SEQ ID NO: 38310 - DNA, 15 bp, Homo sapiens
tgagggcctgaggcc

SEQ ID NO: 38311 - DNA, 15 bp, Homo sapiens
gtgagggcctgaggc

SEQ ID NO: 38312 - DNA, 15 bp, Homo sapiens
ggtgagggcctgagg

SEQ ID NO: 38313 - DNA, 15 bp, Homo sapiens
aggtgagggcctgag

SEQ ID NO: 38314 - DNA, 15 bp, Homo sapiens
taggtgagggcctga

SEQ ID NO: 38315 - DNA, 15 bp, Homo sapiens
ttaggtgagggcctg

SEQ ID NO: 38316 - DNA, 15 bp, Homo sapiens
gttaggtgagggcct

SEQ ID NO: 38317 - DNA, 15 bp, Homo sapiens
tgttaggtgagggcc

SEQ ID NO: 38318 - DNA, 15 bp, Homo sapiens
ctgttaggtgagggc

SEQ ID NO: 38319 - DNA, 15 bp, Homo sapiens
actgttaggtgaggg

SEQ ID NO: 38320 - DNA, 15 bp, Homo sapiens
cactgttaggtgagg

SEQ ID NO: 38321 - DNA, 15 bp, Homo sapiens
tcactgttaggtgag

SEQ ID NO: 38322 - DNA, 15 bp, Homo sapiens
ctcactgttaggtga

SEQ ID NO: 38323 - DNA, 15 bp, Homo sapiens
cctcactgttaggtg

SEQ ID NO: 38324 - DNA, 15 bp, Homo sapiens
gcctcactgttaggt

SEQ ID NO: 38325 - DNA, 15 bp, Homo sapiens
tgcctcactgttagg

SEQ ID NO: 38326 - DNA, 15 bp, Homo sapiens
ctgcctcactgttag

SEQ ID NO: 38327 - DNA, 15 bp, Homo sapiens
gctgcctcactgtta

SEQ ID NO: 38328 - DNA, 15 bp, Homo sapiens
tgctgcctcactgtt

SEQ ID NO: 38329 - DNA, 15 bp, Homo sapiens
ctgctgcctcactgt

SEQ ID NO: 38330 - DNA, 15 bp, Homo sapiens
gctgctgcctcactg

SEQ ID NO: 38331 - DNA, 15 bp, Homo sapiens
agctgctgcctcact

SEQ ID NO: 38332 - DNA, 15 bp, Homo sapiens
cagctgctgcctcac

SEQ ID NO: 38333 - DNA, 15 bp, Homo sapiens
gcagctgctgcctca

SEQ ID NO: 38334 - DNA, 15 bp, Homo sapiens
ggcagctgctgcctc

SEQ ID NO: 38335 - DNA, 15 bp, Homo sapiens
gggcagctgctgcct

SEQ ID NO: 38336 - DNA, 15 bp, Homo sapiens
tgggcagctgctgcc

SEQ ID NO: 38337 - DNA, 15 bp, Homo sapiens
ctgggcagctgctgc

SEQ ID NO: 38338 - DNA, 15 bp, Homo sapiens
gctgggcagctgctg

SEQ ID NO: 38339 - DNA, 15 bp, Homo sapiens
ggctgggcagctgct

SEQ ID NO: 38340 - DNA, 15 bp, Homo sapiens
gggctgggcagctgc

SEQ ID NO: 38341 - DNA, 15 bp, Homo sapiens
ggggctgggcagctg

SEQ ID NO: 38342 - DNA, 15 bp, Homo sapiens
cggggctgggcagct

SEQ ID NO: 38343 - DNA, 15 bp, Homo sapiens
gcggggctgggcagc

SEQ ID NO: 38344 - DNA, 15 bp, Homo sapiens
tgcggggctgggcag

SEQ ID NO: 38345 - DNA, 15 bp, Homo sapiens
ttgcggggctgggca

SEQ ID NO: 38346 - DNA, 15 bp, Homo sapiens
attgcggggctgggc

SEQ ID NO: 38347 - DNA, 15 bp, Homo sapiens
cattgcggggctggg

SEQ ID NO: 38348 - DNA, 15 bp, Homo sapiens
acattgcggggctgg

SEQ ID NO: 38349 - DNA, 15 bp, Homo sapiens
cacattgcggggctg

SEQ ID NO: 38350 - DNA, 15 bp, Homo sapiens
gcacattgcggggct

SEQ ID NO: 38351 - DNA, 15 bp, Homo sapiens
ggcacattgcggggc

SEQ ID NO: 38352 - DNA, 15 bp, Homo sapiens
aggcacattgcgggg

SEQ ID NO: 38353 - DNA, 15 bp, Homo sapiens
caggcacattgcggg

SEQ ID NO: 38354 - DNA, 15 bp, Homo sapiens
gcaggcacattgcgg

SEQ ID NO: 38355 - DNA, 15 bp, Homo sapiens
agcaggcacattgcg

SEQ ID NO: 38356 - DNA, 15 bp, Homo sapiens
cagcaggcacattgc

SEQ ID NO: 38357 - DNA, 15 bp, Homo sapiens
acagcaggcacattg

SEQ ID NO: 38358 - DNA, 15 bp, Homo sapiens
gacagcaggcacatt

SEQ ID NO: 38359 - DNA, 15 bp, Homo sapiens
tgacagcaggcacat

SEQ ID NO: 38360 - DNA, 15 bp, Homo sapiens
ctgacagcaggcaca

SEQ ID NO: 38361 - DNA, 15 bp, Homo sapiens
cctgacagcaggcac

SEQ ID NO: 38362 - DNA, 15 bp, Homo sapiens
gcctgacagcaggca

SEQ ID NO: 38363 - DNA, 15 bp, Homo sapiens
tgcctgacagcaggc

SEQ ID NO: 38364 - DNA, 15 bp, Homo sapiens
ctgcctgacagcagg

SEQ ID NO: 38365 - DNA, 15 bp, Homo sapiens
gctgcctgacagcag

SEQ ID NO: 38366 - DNA, 15 bp, Homo sapiens
agctgcctgacagca

SEQ ID NO: 38367 - DNA, 15 bp, Homo sapiens
gagctgcctgacagc

SEQ ID NO: 38368 - DNA, 15 bp, Homo sapiens
agagctgcctgacag

SEQ ID NO: 38369 - DNA, 15 bp, Homo sapiens
aagagctgcctgaca

SEQ ID NO: 38370 - DNA, 15 bp, Homo sapiens
caagagctgcctgac

SEQ ID NO: 38371 - DNA, 15 bp, Homo sapiens
gcaagagctgcctga

SEQ ID NO: 38372 - DNA, 15 bp, Homo sapiens
ggcaagagctgcctg

SEQ ID NO: 38373 - DNA, 15 bp, Homo sapiens
aggcaagagctgcct

SEQ ID NO: 38374 - DNA, 15 bp, Homo sapiens
caggcaagagctgcc

SEQ ID NO: 38375 - DNA, 15 bp, Homo sapiens
tcaggcaagagctgc

SEQ ID NO: 38376 - DNA, 15 bp, Homo sapiens
ttcaggcaagagctg

SEQ ID NO: 38377 - DNA, 15 bp, Homo sapiens
tttcaggcaagagct

SEQ ID NO: 38378 - DNA, 15 bp, Homo sapiens
gtttcaggcaagagc

SEQ ID NO: 38379 - DNA, 15 bp, Homo sapiens
agtttcaggcaagag

SEQ ID NO: 38380 - DNA, 15 bp, Homo sapiens
aagtttcaggcaaga

SEQ ID NO: 38381 - DNA, 15 bp, Homo sapiens
taagtttcaggcaag

SEQ ID NO: 38382 - DNA, 15 bp, Homo sapiens
gtaagtttcaggcaa

SEQ ID NO: 38383 - DNA, 15 bp, Homo sapiens
agtaagtttcaggca

SEQ ID NO: 38384 - DNA, 15 bp, Homo sapiens
aagtaagtttcaggc

SEQ ID NO: 38385 - DNA, 15 bp, Homo sapiens
gaagtaagtttcagg

SEQ ID NO: 38386 - DNA, 15 bp, Homo sapiens
ggaagtaagtttcag

SEQ ID NO: 38387 - DNA, 15 bp, Homo sapiens
tggaagtaagtttca

SEQ ID NO: 38388 - DNA, 15 bp, Homo sapiens
gtggaagtaagtttc

SEQ ID NO: 38389 - DNA, 15 bp, Homo sapiens
tgtggaagtaagttt

SEQ ID NO: 38390 - DNA, 15 bp, Homo sapiens
atgtggaagtaagtt

SEQ ID NO: 38391 - DNA, 15 bp, Homo sapiens
aatgtggaagtaagt

SEQ ID NO: 38392 - DNA, 15 bp, Homo sapiens
gaatgtggaagtaag

SEQ ID NO: 38393 - DNA, 15 bp, Homo sapiens
agaatgtggaagtaa

SEQ ID NO: 38394 - DNA, 15 bp, Homo sapiens
aagaatgtggaagta

SEQ ID NO: 38395 - DNA, 15 bp, Homo sapiens
aaagaatgtggaagt

SEQ ID NO: 38396 - DNA, 15 bp, Homo sapiens
gaaagaatgtggaag

SEQ ID NO: 38397 - DNA, 15 bp, Homo sapiens
ggaaagaatgtggaa

SEQ ID NO: 38398 - DNA, 15 bp, Homo sapiens
aggaaagaatgtgga

SEQ ID NO: 38399 - DNA, 15 bp, Homo sapiens
caggaaagaatgtgg

SEQ ID NO: 38400 - DNA, 15 bp, Homo sapiens
tcaggaaagaatgtg

SEQ ID NO: 38401 - DNA, 15 bp, Homo sapiens
atcaggaaagaatgt

SEQ ID NO: 38402 - DNA, 15 bp, Homo sapiens
catcaggaaagaatg

SEQ ID NO: 38403 - DNA, 15 bp, Homo sapiens
ccatcaggaaagaat

SEQ ID NO: 38404 - DNA, 15 bp, Homo sapiens
cccatcaggaaagaa

SEQ ID NO: 38405 - DNA, 15 bp, Homo sapiens
gcccatcaggaaaga

SEQ ID NO: 38406 - DNA, 15 bp, Homo sapiens
tgcccatcaggaaag

SEQ ID NO: 38407 - DNA, 15 bp, Homo sapiens
ctgcccatcaggaaa

SEQ ID NO: 38408 - DNA, 15 bp, Homo sapiens
cctgcccatcaggaa

SEQ ID NO: 38409 - DNA, 15 bp, Homo sapiens
acctgcccatcagga

SEQ ID NO: 38410 - DNA, 15 bp, Homo sapiens
cacctgcccatcagg

SEQ ID NO: 38411 - DNA, 15 bp, Homo sapiens
ccacctgcccatcag

SEQ ID NO: 38412 - DNA, 15 bp, Homo sapiens
gccacctgcccatca

SEQ ID NO: 38413 - DNA, 15 bp, Homo sapiens
agccacctgcccatc

SEQ ID NO: 38414 - DNA, 15 bp, Homo sapiens
cagccacctgcccat

SEQ ID NO: 38415 - DNA, 15 bp, Homo sapiens
tcagccacctgccca

SEQ ID NO: 38416 - DNA, 15 bp, Homo sapiens
ttcagccacctgccc

SEQ ID NO: 38417 - DNA, 15 bp, Homo sapiens
cttcagccacctgcc

SEQ ID NO: 38418 - DNA, 15 bp, Homo sapiens
ccttcagccacctgc

SEQ ID NO: 38419 - DNA, 15 bp, Homo sapiens
gccttcagccacctg

SEQ ID NO: 38420 - DNA, 15 bp, Homo sapiens
ggccttcagccacct

SEQ ID NO: 38421 - DNA, 15 bp, Homo sapiens
gggccttcagccacc

SEQ ID NO: 38422 - DNA, 15 bp, Homo sapiens
tgggccttcagccac

SEQ ID NO: 38423 - DNA, 15 bp, Homo sapiens
ctgggccttcagcca

SEQ ID NO: 38424 - DNA, 15 bp, Homo sapiens
gctgggccttcagcc

SEQ ID NO: 38425 - DNA, 15 bp, Homo sapiens
ggctgggccttcagc

SEQ ID NO: 38426 - DNA, 15 bp, Homo sapiens
tggctgggccttcag

SEQ ID NO: 38427 - DNA, 15 bp, Homo sapiens
atggctgggccttca

SEQ ID NO: 38428 - DNA, 15 bp, Homo sapiens
gatggctgggccttc

SEQ ID NO: 38429 - DNA, 15 bp, Homo sapiens
tgatggctgggcctt

SEQ ID NO: 38430 - DNA, 15 bp, Homo sapiens
ctgatggctgggcct

SEQ ID NO: 38431 - DNA, 15 bp, Homo sapiens
actgatggctgggcc

SEQ ID NO: 38432 - DNA, 15 bp, Homo sapiens
cactgatggctgggc

SEQ ID NO: 38433 - DNA, 15 bp, Homo sapiens
acactgatggctggg

SEQ ID NO: 38434 - DNA, 15 bp, Homo sapiens
gacactgatggctgg

SEQ ID NO: 38435 - DNA, 15 bp, Homo sapiens
cgacactgatggctg

SEQ ID NO: 38436 - DNA, 15 bp, Homo sapiens
gcgacactgatggct

SEQ ID NO: 38437 - DNA, 15 bp, Homo sapiens
agcgacactgatggc

SEQ ID NO: 38438 - DNA, 15 bp, Homo sapiens
aagcgacactgatgg

SEQ ID NO: 38439 - DNA, 15 bp, Homo sapiens
caagcgacactgatg

SEQ ID NO: 38440 - DNA, 15 bp, Homo sapiens
acaagcgacactgat

SEQ ID NO: 38441 - DNA, 15 bp, Homo sapiens
aacaagcgacactga

SEQ ID NO: 38442 - DNA, 15 bp, Homo sapiens
caacaagcgacactg

SEQ ID NO: 38443 - DNA, 15 bp, Homo sapiens
gcaacaagcgacact

SEQ ID NO: 38444 - DNA, 15 bp, Homo sapiens
ggcaacaagcgacac

SEQ ID NO: 38445 - DNA, 15 bp, Homo sapiens
tggcaacaagcgaca

SEQ ID NO: 38446 - DNA, 15 bp, Homo sapiens
gtggcaacaagcgac

SEQ ID NO: 38447 - DNA, 15 bp, Homo sapiens
ggtggcaacaagcga

SEQ ID NO: 38448 - DNA, 15 bp, Homo sapiens
gggtggcaacaagcg

SEQ ID NO: 38449 - DNA, 15 bp, Homo sapiens
ggggtggcaacaagc

SEQ ID NO: 38450 - DNA, 15 bp, Homo sapiens
cggggtggcaacaag

SEQ ID NO: 38451 - DNA, 15 bp, Homo sapiens
acggggtggcaacaa

SEQ ID NO: 38452 - DNA, 15 bp, Homo sapiens
cacggggtggcaaca

SEQ ID NO: 38453 - DNA, 15 bp, Homo sapiens
gcacggggtggcaac

SEQ ID NO: 38454 - DNA, 15 bp, Homo sapiens
ggcacggggtggcaa

SEQ ID NO: 38455 - DNA, 15 bp, Homo sapiens
aggcacggggtggca

SEQ ID NO: 38456 - DNA, 15 bp, Homo sapiens
gaggcacggggtggc

SEQ ID NO: 38457 - DNA, 15 bp, Homo sapiens
ggaggcacggggtgg

SEQ ID NO: 38458 - DNA, 15 bp, Homo sapiens
gggaggcacggggtg

SEQ ID NO: 38459 - DNA, 15 bp, Homo sapiens
agggaggcacggggt

SEQ ID NO: 38460 - DNA, 15 bp, Homo sapiens
aagggaggcacgggg

SEQ ID NO: 38461 - DNA, 15 bp, Homo sapiens
caagggaggcacggg

SEQ ID NO: 38462 - DNA, 15 bp, Homo sapiens
ccaagggaggcacgg

SEQ ID NO: 38463 - DNA, 15 bp, Homo sapiens
gccaagggaggcacg

SEQ ID NO: 38464 - DNA, 15 bp, Homo sapiens
ggccaagggaggcac

SEQ ID NO: 38465 - DNA, 15 bp, Homo sapiens
agaggccaagggagg

SEQ ID NO: 38466 - DNA, 15 bp, Homo sapiens
gagaggccaagggag

SEQ ID NO: 38467 - DNA, 15 bp, Homo sapiens
agagaggccaaggga

SEQ ID NO: 38468 - DNA, 15 bp, Homo sapiens
cagagaggccaaggg

SEQ ID NO: 38469 - DNA, 15 bp, Homo sapiens
tcagagaggccaagg

SEQ ID NO: 38470 - DNA, 15 bp, Homo sapiens
ctcagagaggccaag

SEQ ID NO: 38471 - DNA, 15 bp, Homo sapiens
gctcagagaggccaa

SEQ ID NO: 38472 - DNA, 15 bp, Homo sapiens
agctcagagaggcca

SEQ ID NO: 38473 - DNA, 15 bp, Homo sapiens
aagctcagagaggcc

SEQ ID NO: 38474 - DNA, 15 bp, Homo sapiens
aaagctcagagaggc

SEQ ID NO: 38475 - DNA, 15 bp, Homo sapiens
caaagctcagagagg

SEQ ID NO: 38476 - DNA, 15 bp, Homo sapiens
gcaaagctcagagag

SEQ ID NO: 38477 - DNA, 15 bp, Homo sapiens
ggcaaagctcagaga

SEQ ID NO: 38478 - DNA, 15 bp, Homo sapiens
gggcaaagctcagag

SEQ ID NO: 38479 - DNA, 15 bp, Homo sapiens
tgggcaaagctcaga

SEQ ID NO: 38480 - DNA, 15 bp, Homo sapiens
ctgggcaaagctcag

SEQ ID NO: 38481 - DNA, 15 bp, Homo sapiens
tctgggcaaagctca

SEQ ID NO: 38482 - DNA, 15 bp, Homo sapiens
ttctgggcaaagctc

SEQ ID NO: 38483 - DNA, 15 bp, Homo sapiens
cttctgggcaaagct

SEQ ID NO: 38484 - DNA, 15 bp, Homo sapiens
tcttctgggcaaagc

SEQ ID NO: 38485 - DNA, 15 bp, Homo sapiens
gtcttctgggcaaag

SEQ ID NO: 38486 - DNA, 15 bp, Homo sapiens
ggtcttctgggcaaa

SEQ ID NO: 38487 - DNA, 15 bp, Homo sapiens
tggtcttctgggcaa

SEQ ID NO: 38488 - DNA, 15 bp, Homo sapiens
ttggtcttctgggca

SEQ ID NO: 38489 - DNA, 15 bp, Homo sapiens
gttggtcttctgggc

SEQ ID NO: 38490 - DNA, 15 bp, Homo sapiens
tgttggtcttctggg

SEQ ID NO: 38491 - DNA, 15 bp, Homo sapiens
ttgttggtcttctgg

SEQ ID NO: 38492 - DNA, 15 bp, Homo sapiens
attgttggtcttctg

SEQ ID NO: 38493 - DNA, 15 bp, Homo sapiens
gattgttggtcttct

SEQ ID NO: 38494 - DNA, 15 bp, Homo sapiens
tgattgttggtcttc

SEQ ID NO: 38495 - DNA, 15 bp, Homo sapiens
atgattgttggtctt

SEQ ID NO: 38496 - DNA, 15 bp, Homo sapiens
tatgattgttggtct

SEQ ID NO: 38497 - DNA, 15 bp, Homo sapiens
gtatgattgttggtc

SEQ ID NO: 38498 - DNA, 15 bp, Homo sapiens
tgtatgattgttggt

SEQ ID NO: 38499 - DNA, 15 bp, Homo sapiens
atgtatgattgttgg

SEQ ID NO: 38500 - DNA, 15 bp, Homo sapiens
tatgtatgattgttg

SEQ ID NO: 38501 - DNA, 15 bp, Homo sapiens
gtatgtatgattgtt

SEQ ID NO: 38502 - DNA, 15 bp, Homo sapiens
ggtatgtatgattgt

SEQ ID NO: 38503 - DNA, 15 bp, Homo sapiens
gggtatgtatgattg

SEQ ID NO: 38504 - DNA, 15 bp, Homo sapiens
agggtatgtatgatt

SEQ ID NO: 38505 - DNA, 15 bp, Homo sapiens
tagggtatgtatgat

SEQ ID NO: 38506 - DNA, 15 bp, Homo sapiens
ttagggtatgtatga

SEQ ID NO: 38507 - DNA, 15 bp, Homo sapiens
gttagggtatgtatg

SEQ ID NO: 38508 - DNA, 15 bp, Homo sapiens
agttagggtatgtat

SEQ ID NO: 38509 - DNA, 15 bp, Homo sapiens
cagttagggtatgta

SEQ ID NO: 38510 - DNA, 15 bp, Homo sapiens
ccagttagggtatgt

SEQ ID NO: 38511 - DNA, 15 bp, Homo sapiens
cccagttagggtatg

SEQ ID NO: 38512 - DNA, 15 bp, Homo sapiens
tcccagttagggtat

SEQ ID NO: 38513 - DNA, 15 bp, Homo sapiens
gtcccagttagggta

SEQ ID NO: 38514 - DNA, 15 bp, Homo sapiens
tgtcccagttagggt

SEQ ID NO: 38515 - DNA, 15 bp, Homo sapiens
gtgtcccagttaggg

SEQ ID NO: 38516 - DNA, 15 bp, Homo sapiens
ggtgtcccagttagg

SEQ ID NO: 38517 - DNA, 15 bp, Homo sapiens
tggtgtcccagttag

SEQ ID NO: 38518 - DNA, 15 bp, Homo sapiens
gtggtgtcccagtta

SEQ ID NO: 38519 - DNA, 15 bp, Homo sapiens
agtggtgtcccagtt

SEQ ID NO: 38520 - DNA, 15 bp, Homo sapiens
gagtggtgtcccagt

SEQ ID NO: 38521 - DNA, 15 bp, Homo sapiens
agagtggtgtcccag

SEQ ID NO: 38522 - DNA, 15 bp, Homo sapiens
cagagtggtgtccca

SEQ ID NO: 38523 - DNA, 15 bp, Homo sapiens
gcagagtggtgtccc

SEQ ID NO: 38524 - DNA, 15 bp, Homo sapiens
tgcagagtggtgtcc

SEQ ID NO: 38525 - DNA, 15 bp, Homo sapiens
ctgcagagtggtgtc

SEQ ID NO: 38526 - DNA, 15 bp, Homo sapiens
tctgcagagtggtgt

SEQ ID NO: 38527 - DNA, 15 bp, Homo sapiens
ttctgcagagtggtg

SEQ ID NO: 38528 - DNA, 15 bp, Homo sapiens
attctgcagagtggt

SEQ ID NO: 38529 - DNA, 15 bp, Homo sapiens
cattctgcagagtgg

SEQ ID NO: 38530 - DNA, 15 bp, Homo sapiens
gcattctgcagagtg

SEQ ID NO: 38531 - DNA, 15 bp, Homo sapiens
tgcattctgcagagt

SEQ ID NO: 38532 - DNA, 15 bp, Homo sapiens
ctgcattctgcagag

SEQ ID NO: 38533 - DNA, 15 bp, Homo sapiens
tctgcattctgcaga

SEQ ID NO: 38534 - DNA, 15 bp, Homo sapiens
atctgcattctgcag

SEQ ID NO: 38535 - DNA, 15 bp, Homo sapiens
catctgcattctgca

SEQ ID NO: 38536 - DNA, 15 bp, Homo sapiens
tcatctgcattctgc

SEQ ID NO: 38537 - DNA, 15 bp, Homo sapiens
atcatctgcattctg

SEQ ID NO: 38538 - DNA, 15 bp, Homo sapiens
gatcatctgcattct

SEQ ID NO: 38539 - DNA, 15 bp, Homo sapiens
ggatcatctgcattc

SEQ ID NO: 38540 - DNA, 15 bp, Homo sapiens
tggatcatctgcatt

SEQ ID NO: 38541 - DNA, 15 bp, Homo sapiens
atggatcatctgcat

SEQ ID NO: 38542 - DNA, 15 bp, Homo sapiens
aatggatcatctgca

SEQ ID NO: 38543 - DNA, 15 bp, Homo sapiens
gaatggatcatctgc

SEQ ID NO: 38544 - DNA, 15 bp, Homo sapiens
agaatggatcatctg

SEQ ID NO: 38545 - DNA, 15 bp, Homo sapiens
cagaatggatcatct

SEQ ID NO: 38546 - DNA, 15 bp, Homo sapiens
ccagaatggatcatc

SEQ ID NO: 38547 - DNA, 15 bp, Homo sapiens
tccagaatggatcat

SEQ ID NO: 38548 - DNA, 15 bp, Homo sapiens
ctccagaatggatca

SEQ ID NO: 38549 - DNA, 15 bp, Homo sapiens
cctccagaatggatc

SEQ ID NO: 38550 - DNA, 15 bp, Homo sapiens
tcctccagaatggat

SEQ ID NO: 38551 - DNA, 15 bp, Homo sapiens
ttcctccagaatgga

SEQ ID NO: 38552 - DNA, 15 bp, Homo sapiens
cttcctccagaatgg

SEQ ID NO: 38553 - DNA, 15 bp, Homo sapiens
gcttcctccagaatg

SEQ ID NO: 38554 - DNA, 15 bp, Homo sapiens
agcttcctccagaat

SEQ ID NO: 38555 - DNA, 15 bp, Homo sapiens
cagcttcctccagaa

SEQ ID NO: 38556 - DNA, 15 bp, Homo sapiens
acagcttcctccaga

SEQ ID NO: 38557 - DNA, 15 bp, Homo sapiens
gacagcttcctccag

SEQ ID NO: 38558 - DNA, 15 bp, Homo sapiens
ggacagcttcctcca

SEQ ID NO: 38559 - DNA, 15 bp, Homo sapiens
gggacagcttcctcc

SEQ ID NO: 38560 - DNA, 15 bp, Homo sapiens
agggacagcttcctc

SEQ ID NO: 38561 - DNA, 15 bp, Homo sapiens
aagggacagcttcct

SEQ ID NO: 38562 - DNA, 15 bp, Homo sapiens
caagggacagcttcc

SEQ ID NO: 38563 - DNA, 15 bp, Homo sapiens
tcaagggacagcttc

SEQ ID NO: 38564 - DNA, 15 bp, Homo sapiens
ctcaagggacagctt

SEQ ID NO: 38565 - DNA, 15 bp, Homo sapiens
gctcaagggacagct

SEQ ID NO: 38566 - DNA, 15 bp, Homo sapiens
agctcaagggacagc

SEQ ID NO: 38567 - DNA, 15 bp, Homo sapiens
gagctcaagggacag

SEQ ID NO: 38568 - DNA, 15 bp, Homo sapiens
tgagctcaagggaca

SEQ ID NO: 38569 - DNA, 15 bp, Homo sapiens
ctgagctcaagggac

SEQ ID NO: 38570 - DNA, 15 bp, Homo sapiens
actgagctcaaggga

SEQ ID NO: 38571 - DNA, 15 bp, Homo sapiens
cactgagctcaaggg

SEQ ID NO: 38572 - DNA, 15 bp, Homo sapiens
tcactgagctcaagg

SEQ ID NO: 38573 - DNA, 15 bp, Homo sapiens
ctcactgagctcaag

SEQ ID NO: 38574 - DNA, 15 bp, Homo sapiens
gctcactgagctcaa

SEQ ID NO: 38575 - DNA, 15 bp, Homo sapiens
agctcactgagctca

SEQ ID NO: 38576 - DNA, 15 bp, Homo sapiens
gagctcactgagctc

SEQ ID NO: 38577 - DNA, 15 bp, Homo sapiens
ggagctcactgagct

SEQ ID NO: 38578 - DNA, 15 bp, Homo sapiens
gggagctcactgagc

SEQ ID NO: 38579 - DNA, 15 bp, Homo sapiens
tgggagctcactgag

SEQ ID NO: 38580 - DNA, 15 bp, Homo sapiens
ctgggagctcactga

SEQ ID NO: 38581 - DNA, 15 bp, Homo sapiens
cctgggagctcactg

SEQ ID NO: 38582 - DNA, 15 bp, Homo sapiens
gcctgggagctcact

SEQ ID NO: 38583 - DNA, 15 bp, Homo sapiens
tgcctgggagctcac

SEQ ID NO: 38584 - DNA, 15 bp, Homo sapiens
ttgcctgggagctca

SEQ ID NO: 38585 - DNA, 15 bp, Homo sapiens
cttgcctgggagctc

SEQ ID NO: 38586 - DNA, 15 bp, Homo sapiens
gcttgcctgggagct

SEQ ID NO: 38587 - DNA, 15 bp, Homo sapiens
tgcttgcctgggagc

SEQ ID NO: 38588 - DNA, 15 bp, Homo sapiens
ctgcttgcctgggag

SEQ ID NO: 38589 - DNA, 15 bp, Homo sapiens
cctgcttgcctggga

SEQ ID NO: 38590 - DNA, 15 bp, Homo sapiens
ccctgcttgcctggg

SEQ ID NO: 38591 - DNA, 15 bp, Homo sapiens
gccctgcttgcctgg

SEQ ID NO: 38592 - DNA, 15 bp, Homo sapiens
tgccctgcttgcctg

SEQ ID NO: 38593 - DNA, 15 bp, Homo sapiens
atgccctgcttgcct

SEQ ID NO: 38594 - DNA, 15 bp, Homo sapiens
gatgccctgcttgcc

SEQ ID NO: 38595 - DNA, 15 bp, Homo sapiens
agatgccctgcttgc

SEQ ID NO: 38596 - DNA, 15 bp, Homo sapiens
cagatgccctgcttg

SEQ ID NO: 38597 - DNA, 15 bp, Homo sapiens
ccagatgccctgctt

SEQ ID NO: 38598 - DNA, 15 bp, Homo sapiens
gccagatgccctgct

SEQ ID NO: 38599 - DNA, 15 bp, Homo sapiens
ggccagatgccctgc

SEQ ID NO: 38600 - DNA, 15 bp, Homo sapiens
cggccagatgccctg

SEQ ID NO: 38601 - DNA, 15 bp, Homo sapiens
tcggccagatgccct

SEQ ID NO: 38602 - DNA, 15 bp, Homo sapiens
gtcggccagatgccc

SEQ ID NO: 38603 - DNA, 15 bp, Homo sapiens
agtcggccagatgcc

SEQ ID NO: 38604 - DNA, 15 bp, Homo sapiens
aagtcggccagatgc

SEQ ID NO: 38605 - DNA, 15 bp, Homo sapiens
gaagtcggccagatg

SEQ ID NO: 38606 - DNA, 15 bp, Homo sapiens
ggaagtcggccagat

SEQ ID NO: 38607 - DNA, 15 bp, Homo sapiens
gggaagtcggccaga

SEQ ID NO: 38608 - DNA, 15 bp, Homo sapiens
agggaagtcggccag

SEQ ID NO: 38609 - DNA, 15 bp, Homo sapiens
gagggaagtcggcca

SEQ ID NO: 38610 - DNA, 15 bp, Homo sapiens
tgagggaagtcggcc

SEQ ID NO: 38611 - DNA, 15 bp, Homo sapiens
gtgagggaagtcggc

SEQ ID NO: 38612 - DNA, 15 bp, Homo sapiens
tgtgagggaagtcgg

SEQ ID NO: 38613 - DNA, 15 bp, Homo sapiens
ttgtgagggaagtcg

SEQ ID NO: 38614 - DNA, 15 bp, Homo sapiens
gttgtgagggaagtc

SEQ ID NO: 38615 - DNA, 15 bp, Homo sapiens
tgttgtgagggaagt

SEQ ID NO: 38616 - DNA, 15 bp, Homo sapiens
ctgttgtgagggaag

SEQ ID NO: 38617 - DNA, 15 bp, Homo sapiens
gctgttgtgagggaa

SEQ ID NO: 38618 - DNA, 15 bp, Homo sapiens
agctgttgtgaggga

SEQ ID NO: 38619 - DNA, 15 bp, Homo sapiens
cagctgttgtgaggg

SEQ ID NO: 38620 - DNA, 15 bp, Homo sapiens
gcagctgttgtgagg

SEQ ID NO: 38621 - DNA, 15 bp, Homo sapiens
agcagctgttgtgag

SEQ ID NO: 38622 - DNA, 15 bp, Homo sapiens
gagcagctgttgtga

SEQ ID NO: 38623 - DNA, 15 bp, Homo sapiens
ggagcagctgttgtg

SEQ ID NO: 38624 - DNA, 15 bp, Homo sapiens
gggagcagctgttgt

SEQ ID NO: 38625 - DNA, 15 bp, Homo sapiens
tgggagcagctgttg

SEQ ID NO: 38626 - DNA, 15 bp, Homo sapiens
gtgggagcagctgtt

SEQ ID NO: 38627 - DNA, 15 bp, Homo sapiens
tgtgggagcagctgt

SEQ ID NO: 38628 - DNA, 15 bp, Homo sapiens
atgtgggagcagctg

SEQ ID NO: 38629 - DNA, 15 bp, Homo sapiens
gatgtgggagcagct

SEQ ID NO: 38630 - DNA, 15 bp, Homo sapiens
ggatgtgggagcagc

SEQ ID NO: 38631 - DNA, 15 bp, Homo sapiens
gggatgtgggagcag

SEQ ID NO: 38632 - DNA, 15 bp, Homo sapiens
ggggatgtgggagca

SEQ ID NO: 38633 - DNA, 15 bp, Homo sapiens
aggggatgtgggagc

SEQ ID NO: 38634 - DNA, 15 bp, Homo sapiens
gaggggatgtgggag

SEQ ID NO: 38635 - DNA, 15 bp, Homo sapiens
cgaggggatgtggga

SEQ ID NO: 38636 - DNA, 15 bp, Homo sapiens
ccgaggggatgtggg

SEQ ID NO: 38637 - DNA, 15 bp, Homo sapiens
tccgaggggatgtgg

SEQ ID NO: 38638 - DNA, 15 bp, Homo sapiens
gtccgaggggatgtg

SEQ ID NO: 38639 - DNA, 15 bp, Homo sapiens
agtccgaggggatgt

SEQ ID NO: 38640 - DNA, 15 bp, Homo sapiens
cagtccgaggggatg

SEQ ID NO: 38641 - DNA, 15 bp, Homo sapiens
ccagtccgaggggat

SEQ ID NO: 38642 - DNA, 15 bp, Homo sapiens
tccagtccgagggga

SEQ ID NO: 38643 - DNA, 15 bp, Homo sapiens
ctccagtccgagggg

SEQ ID NO: 38644 - DNA, 15 bp, Homo sapiens
gctccagtccgaggg

SEQ ID NO: 38645 - DNA, 15 bp, Homo sapiens
agctccagtccgagg

SEQ ID NO: 38646 - DNA, 15 bp, Homo sapiens
aagctccagtccgag

SEQ ID NO: 38647 - DNA, 15 bp, Homo sapiens
gaagctccagtccga

SEQ ID NO: 38648 - DNA, 15 bp, Homo sapiens
tgaagctccagtccg

SEQ ID NO: 38649 - DNA, 15 bp, Homo sapiens
ctgaagctccagtcc

SEQ ID NO: 38650 - DNA, 15 bp, Homo sapiens
gctgaagctccagtc

SEQ ID NO: 38651 - DNA, 15 bp, Homo sapiens
ggctgaagctccagt

SEQ ID NO: 38652 - DNA, 15 bp, Homo sapiens
gggctgaagctccag

SEQ ID NO: 38653 - DNA, 15 bp, Homo sapiens
agggctgaagctcca

SEQ ID NO: 38654 - DNA, 15 bp, Homo sapiens
cagggctgaagctcc

SEQ ID NO: 38655 - DNA, 15 bp, Homo sapiens
tcagggctgaagctc

SEQ ID NO: 38656 - DNA, 15 bp, Homo sapiens
gtcagggctgaagct

SEQ ID NO: 38657 - DNA, 15 bp, Homo sapiens
agtcagggctgaagc

SEQ ID NO: 38658 - DNA, 15 bp, Homo sapiens
cagtcagggctgaag

SEQ ID NO: 38659 - DNA, 15 bp, Homo sapiens
tcagtcagggctgaa

SEQ ID NO: 38660 - DNA, 15 bp, Homo sapiens
ctcagtcagggctga

SEQ ID NO: 38661 - DNA, 15 bp, Homo sapiens
cctcagtcagggctg

SEQ ID NO: 38662 - DNA, 15 bp, Homo sapiens
acctcagtcagggct

SEQ ID NO: 38663 - DNA, 15 bp, Homo sapiens
cacctcagtcagggc

SEQ ID NO: 38664 - DNA, 15 bp, Homo sapiens
ccacctcagtcaggg

SEQ ID NO: 38665 - DNA, 15 bp, Homo sapiens
cccacctcagtcagg

SEQ ID NO: 38666 - DNA, 15 bp, Homo sapiens
gcccacctcagtcag

SEQ ID NO: 38667 - DNA, 15 bp, Homo sapiens
tgcccacctcagtca

SEQ ID NO: 38668 - DNA, 15 bp, Homo sapiens
ctgcccacctcagtc

SEQ ID NO: 38669 - DNA, 15 bp, Homo sapiens
tctgcccacctcagt

SEQ ID NO: 38670 - DNA, 15 bp, Homo sapiens
gtctgcccacctcag

SEQ ID NO: 38671 - DNA, 15 bp, Homo sapiens
ggtctgcccacctca

SEQ ID NO: 38672 - DNA, 15 bp, Homo sapiens
aggtctgcccacctc

SEQ ID NO: 38673 - DNA, 15 bp, Homo sapiens
taggtctgcccacct

SEQ ID NO: 38674 - DNA, 15 bp, Homo sapiens
ttaggtctgcccacc

SEQ ID NO: 38675 - DNA, 15 bp, Homo sapiens
cttaggtctgcccac

SEQ ID NO: 38676 - DNA, 15 bp, Homo sapiens
tcttaggtctgccca

SEQ ID NO: 38677 - DNA, 15 bp, Homo sapiens
gtcttaggtctgccc

SEQ ID NO: 38678 - DNA, 15 bp, Homo sapiens
ggtcttaggtctgcc

SEQ ID NO: 38679 - DNA, 15 bp, Homo sapiens
aggtcttaggtctgc

SEQ ID NO: 38680 - DNA, 15 bp, Homo sapiens
caggtcttaggtctg

SEQ ID NO: 38681 - DNA, 15 bp, Homo sapiens
tcaggtcttaggtct

SEQ ID NO: 38682 - DNA, 15 bp, Homo sapiens
ctcaggtcttaggtc

SEQ ID NO: 38683 - DNA, 15 bp, Homo sapiens
tctcaggtcttaggt

SEQ ID NO: 38684 - DNA, 15 bp, Homo sapiens
gtctcaggtcttagg

SEQ ID NO: 38685 - DNA, 15 bp, Homo sapiens
ggtctcaggtcttag

SEQ ID NO: 38686 - DNA, 15 bp, Homo sapiens
tggtctcaggtctta

SEQ ID NO: 38687 - DNA, 15 bp, Homo sapiens
gtggtctcaggtctt

SEQ ID NO: 38688 - DNA, 15 bp, Homo sapiens
tgtggtctcaggtct

SEQ ID NO: 38689 - DNA, 15 bp, Homo sapiens
ttgtggtctcaggtc

SEQ ID NO: 38690 - DNA, 15 bp, Homo sapiens
cttgtggtctcaggt

SEQ ID NO: 38691 - DNA, 15 bp, Homo sapiens
tcttgtggtctcagg

SEQ ID NO: 38692 - DNA, 15 bp, Homo sapiens
atcttgtggtctcag

SEQ ID NO: 38693 - DNA, 15 bp, Homo sapiens
aatcttgtggtctca

SEQ ID NO: 38694 - DNA, 15 bp, Homo sapiens
taatcttgtggtctc

SEQ ID NO: 38695 - DNA, 15 bp, Homo sapiens
ctaatcttgtggtct

SEQ ID NO: 38696 - DNA, 15 bp, Homo sapiens
gctaatcttgtggtc

SEQ ID NO: 38697 - DNA, 15 bp, Homo sapiens
agctaatcttgtggt

SEQ ID NO: 38698 - DNA, 15 bp, Homo sapiens
gagctaatcttgtgg

SEQ ID NO: 38699 - DNA, 15 bp, Homo sapiens
tgagctaatcttgtg

SEQ ID NO: 38700 - DNA, 15 bp, Homo sapiens
ctgagctaatcttgt

SEQ ID NO: 38701 - DNA, 15 bp, Homo sapiens
actgagctaatcttg

SEQ ID NO: 38702 - DNA, 15 bp, Homo sapiens
cactgagctaatctt

SEQ ID NO: 38703 - DNA, 15 bp, Homo sapiens
acactgagctaatct

SEQ ID NO: 38704 - DNA, 15 bp, Homo sapiens
gacactgagctaatc

SEQ ID NO: 38705 - DNA, 15 bp, Homo sapiens
agacactgagctaat

SEQ ID NO: 38706 - DNA, 15 bp, Homo sapiens
tagacactgagctaa

SEQ ID NO: 38707 - DNA, 15 bp, Homo sapiens
gtagacactgagcta

SEQ ID NO: 38708 - DNA, 15 bp, Homo sapiens
ggtagacactgagct

SEQ ID NO: 38709 - DNA, 15 bp, Homo sapiens
tggtagacactgagc

SEQ ID NO: 38710 - DNA, 15 bp, Homo sapiens
ttggtagacactgag

SEQ ID NO: 38711 - DNA, 15 bp, Homo sapiens
cttggtagacactga

SEQ ID NO: 38712 - DNA, 15 bp, Homo sapiens
gcttggtagacactg

SEQ ID NO: 38713 - DNA, 15 bp, Homo sapiens
tgcttggtagacact

SEQ ID NO: 38714 - DNA, 15 bp, Homo sapiens
atgcttggtagacac

SEQ ID NO: 38715 - DNA, 15 bp, Homo sapiens
gatgcttggtagaca

SEQ ID NO: 38716 - DNA, 15 bp, Homo sapiens
agatgcttggtagac

SEQ ID NO: 38717 - DNA, 15 bp, Homo sapiens
tagatgcttggtaga

SEQ ID NO: 38718 - DNA, 15 bp, Homo sapiens
ctagatgcttggtag

SEQ ID NO: 38719 - DNA, 15 bp, Homo sapiens
gctagatgcttggta

SEQ ID NO: 38720 - DNA, 15 bp, Homo sapiens
ggctagatgcttggt

SEQ ID NO: 38721 - DNA, 15 bp, Homo sapiens
tggctagatgcttgg

SEQ ID NO: 38722 - DNA, 15 bp, Homo sapiens
gtggctagatgcttg

SEQ ID NO: 38723 - DNA, 15 bp, Homo sapiens
agtggctagatgctt

SEQ ID NO: 38724 - DNA, 15 bp, Homo sapiens
cagtggctagatgct

SEQ ID NO: 38725 - DNA, 15 bp, Homo sapiens
acagtggctagatgc

SEQ ID NO: 38726 - DNA, 15 bp, Homo sapiens
gacagtggctagatg

SEQ ID NO: 38727 - DNA, 15 bp, Homo sapiens
ggacagtggctagat

SEQ ID NO: 38728 - DNA, 15 bp, Homo sapiens
tggacagtggctaga

SEQ ID NO: 38729 - DNA, 15 bp, Homo sapiens
ctggacagtggctag

SEQ ID NO: 38730 - DNA, 15 bp, Homo sapiens
cctggacagtggcta

SEQ ID NO: 38731 - DNA, 15 bp, Homo sapiens
ccctggacagtggct

SEQ ID NO: 38732 - DNA, 15 bp, Homo sapiens
gccctggacagtggc

SEQ ID NO: 38733 - DNA, 15 bp, Homo sapiens
ggccctggacagtgg

SEQ ID NO: 38734 - DNA, 15 bp, Homo sapiens
tggccctggacagtg

SEQ ID NO: 38735 - DNA, 15 bp, Homo sapiens
ctggccctggacagt

SEQ ID NO: 38736 - DNA, 15 bp, Homo sapiens
tctggccctggacag

SEQ ID NO: 38737 - DNA, 15 bp, Homo sapiens
ctctggccctggaca

SEQ ID NO: 38738 - DNA, 15 bp, Homo sapiens
gctctggccctggac

SEQ ID NO: 38739 - DNA, 15 bp, Homo sapiens
tgctctggccctgga

SEQ ID NO: 38740 - DNA, 15 bp, Homo sapiens
atgctctggccctgg

SEQ ID NO: 38741 - DNA, 15 bp, Homo sapiens
tatgctctggccctg

SEQ ID NO: 38742 - DNA, 15 bp, Homo sapiens
gtatgctctggccct

SEQ ID NO: 38743 - DNA, 15 bp, Homo sapiens
ggtatgctctggccc

SEQ ID NO: 38744 - DNA, 15 bp, Homo sapiens
tggtatgctctggcc

SEQ ID NO: 38745 - DNA, 15 bp, Homo sapiens
gtggtatgctctggc

SEQ ID NO: 38746 - DNA, 15 bp, Homo sapiens
cgtggtatgctctgg

SEQ ID NO: 38747 - DNA, 15 bp, Homo sapiens
acgtggtatgctctg

SEQ ID NO: 38748 - DNA, 15 bp, Homo sapiens
gacgtggtatgctct

SEQ ID NO: 38749 - DNA, 15 bp, Homo sapiens
agacgtggtatgctc

SEQ ID NO: 38750 - DNA, 15 bp, Homo sapiens
cagacgtggtatgct

SEQ ID NO: 38751 - DNA, 15 bp, Homo sapiens
gcagacgtggtatgc

SEQ ID NO: 38752 - DNA, 15 bp, Homo sapiens
tgcagacgtggtatg

SEQ ID NO: 38753 - DNA, 15 bp, Homo sapiens
ctgcagacgtggtat

SEQ ID NO: 38754 - DNA, 15 bp, Homo sapiens
actgcagacgtggta

SEQ ID NO: 38755 - DNA, 15 bp, Homo sapiens
cactgcagacgtggt

SEQ ID NO: 38756 - DNA, 15 bp, Homo sapiens
gcactgcagacgtgg

SEQ ID NO: 38757 - DNA, 15 bp, Homo sapiens
ggcactgcagacgtg

SEQ ID NO: 38758 - DNA, 15 bp, Homo sapiens
aggcactgcagacgt

SEQ ID NO: 38759 - DNA, 15 bp, Homo sapiens
caggcactgcagacg

SEQ ID NO: 38760 - DNA, 15 bp, Homo sapiens
acaggcactgcagac

SEQ ID NO: 38761 - DNA, 15 bp, Homo sapiens
cacaggcactgcaga

SEQ ID NO: 38762 - DNA, 15 bp, Homo sapiens
tcacaggcactgcag

SEQ ID NO: 38763 - DNA, 15 bp, Homo sapiens
ctcacaggcactgca

SEQ ID NO: 38764 - DNA, 15 bp, Homo sapiens
gctcacaggcactgc

SEQ ID NO: 38765 - DNA, 15 bp, Homo sapiens
tgctcacaggcactg

SEQ ID NO: 38766 - DNA, 15 bp, Homo sapiens
ctgctcacaggcact

SEQ ID NO: 38767 - DNA, 15 bp, Homo sapiens
tctgctcacaggcac

SEQ ID NO: 38768 - DNA, 15 bp, Homo sapiens
ctctgctcacaggca

SEQ ID NO: 38769 - DNA, 15 bp, Homo sapiens
gctctgctcacaggc

SEQ ID NO: 38770 - DNA, 15 bp, Homo sapiens
ggctctgctcacagg

SEQ ID NO: 38771 - DNA, 15 bp, Homo sapiens
tggctctgctcacag

SEQ ID NO: 38772 - DNA, 15 bp, Homo sapiens
ctggctctgctcaca

SEQ ID NO: 38773 - DNA, 15 bp, Homo sapiens
gctggctctgctcac

SEQ ID NO: 38774 - DNA, 15 bp, Homo sapiens
tgctggctctgctca

SEQ ID NO: 38775 - DNA, 15 bp, Homo sapiens
ctgctggctctgctc

SEQ ID NO: 38776 - DNA, 15 bp, Homo sapiens
actgctggctctgct

SEQ ID NO: 38777 - DNA, 15 bp, Homo sapiens
aactgctggctctgc

SEQ ID NO: 38778 - DNA, 15 bp, Homo sapiens
caactgctggctctg

SEQ ID NO: 38779 - DNA, 15 bp, Homo sapiens
gcaactgctggctct

SEQ ID NO: 38780 - DNA, 15 bp, Homo sapiens
ggcaactgctggctc

SEQ ID NO: 38781 - DNA, 15 bp, Homo sapiens
gggcaactgctggct

SEQ ID NO: 38782 - DNA, 15 bp, Homo sapiens
agggcaactgctggc

SEQ ID NO: 38783 - DNA, 15 bp, Homo sapiens
cagggcaactgctgg

SEQ ID NO: 38784 - DNA, 15 bp, Homo sapiens
acagggcaactgctg

SEQ ID NO: 38785 - DNA, 15 bp, Homo sapiens
cacagggcaactgct

SEQ ID NO: 38786 - DNA, 15 bp, Homo sapiens
tcacagggcaactgc

SEQ ID NO: 38787 - DNA, 15 bp, Homo sapiens
gtcacagggcaactg

SEQ ID NO: 38788 - DNA, 15 bp, Homo sapiens
agtcacagggcaact

SEQ ID NO: 38789 - DNA, 15 bp, Homo sapiens
cagtcacagggcaac

SEQ ID NO: 38790 - DNA, 15 bp, Homo sapiens
acagtcacagggcaa

SEQ ID NO: 38791 - DNA, 15 bp, Homo sapiens
tacagtcacagggca

SEQ ID NO: 38792 - DNA, 15 bp, Homo sapiens
ttacagtcacagggc

SEQ ID NO: 38793 - DNA, 15 bp, Homo sapiens
gttacagtcacaggg

SEQ ID NO: 38794 - DNA, 15 bp, Homo sapiens
ggttacagtcacagg

SEQ ID NO: 38795 - DNA, 15 bp, Homo sapiens
tggttacagtcacag

SEQ ID NO: 38796 - DNA, 15 bp, Homo sapiens
gtggttacagtcaca

SEQ ID NO: 38797 - DNA, 15 bp, Homo sapiens
ggtggttacagtcac

SEQ ID NO: 38798 - DNA, 15 bp, Homo sapiens
tggtggttacagtca

SEQ ID NO: 38799 - DNA, 15 bp, Homo sapiens
ttggtggttacagtc

SEQ ID NO: 38800 - DNA, 15 bp, Homo sapiens
tttggtggttacagt

SEQ ID NO: 38801 - DNA, 15 bp, Homo sapiens
atttggtggttacag

SEQ ID NO: 38802 - DNA, 15 bp, Homo sapiens
aatttggtggttaca

SEQ ID NO: 38803 - DNA, 15 bp, Homo sapiens
caatttggtggttac

SEQ ID NO: 38804 - DNA, 15 bp, Homo sapiens
acaatttggtggtta

SEQ ID NO: 38805 - DNA, 15 bp, Homo sapiens
gacaatttggtggtt

SEQ ID NO: 38806 - DNA, 15 bp, Homo sapiens
ggacaatttggtggt

SEQ ID NO: 38807 - DNA, 15 bp, Homo sapiens
tggacaatttggtgg

SEQ ID NO: 38808 - DNA, 15 bp, Homo sapiens
ttggacaatttggtg

SEQ ID NO: 38809 - DNA, 15 bp, Homo sapiens
tttggacaatttggt

SEQ ID NO: 38810 - DNA, 15 bp, Homo sapiens
gtttggacaatttgg

SEQ ID NO: 38811 - DNA, 15 bp, Homo sapiens
tgtttggacaatttg

SEQ ID NO: 38812 - DNA, 15 bp, Homo sapiens
gtgtttggacaattt

SEQ ID NO: 38813 - DNA, 15 bp, Homo sapiens
ggtgtttggacaatt

SEQ ID NO: 38814 - DNA, 15 bp, Homo sapiens
gggtgtttggacaat

SEQ ID NO: 38815 - DNA, 15 bp, Homo sapiens
cgggtgtttggacaa

SEQ ID NO: 38816 - DNA, 15 bp, Homo sapiens
gcgggtgtttggaca

SEQ ID NO: 38817 - DNA, 15 bp, Homo sapiens
agcgggtgtttggac

SEQ ID NO: 38818 - DNA, 15 bp, Homo sapiens
cagcgggtgtttgga

SEQ ID NO: 38819 - DNA, 15 bp, Homo sapiens
gcagcgggtgtttgg

SEQ ID NO: 38820 - DNA, 15 bp, Homo sapiens
tgcagcgggtgtttg

SEQ ID NO: 38821 - DNA, 15 bp, Homo sapiens
ctgcagcgggtgttt

SEQ ID NO: 38822 - DNA, 15 bp, Homo sapiens
actgcagcgggtgtt

SEQ ID NO: 38823 - DNA, 15 bp, Homo sapiens
aactgcagcgggtgt

SEQ ID NO: 38824 - DNA, 15 bp, Homo sapiens
taactgcagcgggtg

SEQ ID NO: 38825 - DNA, 15 bp, Homo sapiens
ctaactgcagcgggt

SEQ ID NO: 38826 - DNA, 15 bp, Homo sapiens
gctaactgcagcggg

SEQ ID NO: 38827 - DNA, 15 bp, Homo sapiens
tgctaactgcagcgg

SEQ ID NO: 38828 - DNA, 15 bp, Homo sapiens
ttgctaactgcagcg

SEQ ID NO: 38829 - DNA, 15 bp, Homo sapiens
cttgctaactgcagc

SEQ ID NO: 38830 - DNA, 15 bp, Homo sapiens
tcttgctaactgcag

SEQ ID NO: 38831 - DNA, 15 bp, Homo sapiens
ttcttgctaactgca

SEQ ID NO: 38832 - DNA, 15 bp, Homo sapiens
cttcttgctaactgc

SEQ ID NO: 38833 - DNA, 15 bp, Homo sapiens
ccttcttgctaactg

SEQ ID NO: 38834 - DNA, 15 bp, Homo sapiens
cccttcttgctaact

SEQ ID NO: 38835 - DNA, 15 bp, Homo sapiens
acccttcttgctaac

SEQ ID NO: 38836 - DNA, 15 bp, Homo sapiens
tacccttcttgctaa

SEQ ID NO: 38837 - DNA, 15 bp, Homo sapiens
ctacccttcttgcta

SEQ ID NO: 38838 - DNA, 15 bp, Homo sapiens
cctacccttcttgct

SEQ ID NO: 38839 - DNA, 15 bp, Homo sapiens
gcctacccttcttgc

SEQ ID NO: 38840 - DNA, 15 bp, Homo sapiens
agcctacccttcttg

SEQ ID NO: 38841 - DNA, 15 bp, Homo sapiens
aagcctacccttctt

SEQ ID NO: 38842 - DNA, 15 bp, Homo sapiens
gaagcctacccttct

SEQ ID NO: 38843 - DNA, 15 bp, Homo sapiens
tgaagcctacccttc

SEQ ID NO: 38844 - DNA, 15 bp, Homo sapiens
gtgaagcctaccctt

SEQ ID NO: 38845 - DNA, 15 bp, Homo sapiens
ggtgaagcctaccct

SEQ ID NO: 38846 - DNA, 15 bp, Homo sapiens
gggtgaagcctaccc

SEQ ID NO: 38847 - DNA, 15 bp, Homo sapiens
agggtgaagcctacc

SEQ ID NO: 38848 - DNA, 15 bp, Homo sapiens
gagggtgaagcctac

SEQ ID NO: 38849 - DNA, 15 bp, Homo sapiens
ggagggtgaagccta

SEQ ID NO: 38850 - DNA, 15 bp, Homo sapiens
aggagggtgaagcct

SEQ ID NO: 38851 - DNA, 15 bp, Homo sapiens
aaggagggtgaagcc

SEQ ID NO: 38852 - DNA, 15 bp, Homo sapiens
aaaggagggtgaagc

SEQ ID NO: 38853 - DNA, 15 bp, Homo sapiens
taaaggagggtgaag

SEQ ID NO: 38854 - DNA, 15 bp, Homo sapiens
gtaaaggagggtgaa

SEQ ID NO: 38855 - DNA, 15 bp, Homo sapiens
agtaaaggagggtga

SEQ ID NO: 38856 - DNA, 15 bp, Homo sapiens
cagtaaaggagggtg

SEQ ID NO: 38857 - DNA, 15 bp, Homo sapiens
tcagtaaaggagggt

SEQ ID NO: 38858 - DNA, 15 bp, Homo sapiens
ctcagtaaaggaggg

SEQ ID NO: 38859 - DNA, 15 bp, Homo sapiens
cctcagtaaaggagg

SEQ ID NO: 38860 - DNA, 15 bp, Homo sapiens
tcctcagtaaaggag

SEQ ID NO: 38861 - DNA, 15 bp, Homo sapiens
ctcctcagtaaagga

SEQ ID NO: 38862 - DNA, 15 bp, Homo sapiens
tctcctcagtaaagg

SEQ ID NO: 38863 - DNA, 15 bp, Homo sapiens
ttctcctcagtaaag

SEQ ID NO: 38864 - DNA, 15 bp, Homo sapiens
attctcctcagtaaa

SEQ ID NO: 38865 - DNA, 15 bp, Homo sapiens
cattctcctcagtaa

SEQ ID NO: 38866 - DNA, 15 bp, Homo sapiens
tcattctcctcagta

SEQ ID NO: 38867 - DNA, 15 bp, Homo sapiens
atcattctcctcagt

SEQ ID NO: 38868 - DNA, 15 bp, Homo sapiens
catcattctcctcag

SEQ ID NO: 38869 - DNA, 15 bp, Homo sapiens
gcatcattctcctca

SEQ ID NO: 38870 - DNA, 15 bp, Homo sapiens
cgcatcattctcctc

SEQ ID NO: 38871 - DNA, 15 bp, Homo sapiens
ccgcatcattctcct

SEQ ID NO: 38872 - DNA, 15 bp, Homo sapiens
tccgcatcattctcc

SEQ ID NO: 38873 - DNA, 15 bp, Homo sapiens
ctccgcatcattctc

SEQ ID NO: 38874 - DNA, 15 bp, Homo sapiens
cctccgcatcattct

SEQ ID NO: 38875 - DNA, 15 bp, Homo sapiens
tcctccgcatcattc

SEQ ID NO: 38876 - DNA, 15 bp, Homo sapiens
ctcctccgcatcatt

SEQ ID NO: 38877 - DNA, 15 bp, Homo sapiens
actcctccgcatcat

SEQ ID NO: 38878 - DNA, 15 bp, Homo sapiens
aactcctccgcatca

SEQ ID NO: 38879 - DNA, 15 bp, Homo sapiens
aaactcctccgcatc

SEQ ID NO: 38880 - DNA, 15 bp, Homo sapiens
gaaactcctccgcat

SEQ ID NO: 38881 - DNA, 15 bp, Homo sapiens
ggaaactcctccgca

SEQ ID NO: 38882 - DNA, 15 bp, Homo sapiens
aggaaactcctccgc

SEQ ID NO: 38883 - DNA, 15 bp, Homo sapiens
gaggaaactcctccg

SEQ ID NO: 38884 - DNA, 15 bp, Homo sapiens
agaggaaactcctcc

SEQ ID NO: 38885 - DNA, 15 bp, Homo sapiens
gagaggaaactcctc

SEQ ID NO: 38886 - DNA, 15 bp, Homo sapiens
ggagaggaaactcct

SEQ ID NO: 38887 - DNA, 15 bp, Homo sapiens
tggagaggaaactcc

SEQ ID NO: 38888 - DNA, 15 bp, Homo sapiens
ctggagaggaaactc

SEQ ID NO: 38889 - DNA, 15 bp, Homo sapiens
cctggagaggaaact

SEQ ID NO: 38890 - DNA, 15 bp, Homo sapiens
ccctggagaggaaac

SEQ ID NO: 38891 - DNA, 15 bp, Homo sapiens
gccctggagaggaaa

SEQ ID NO: 38892 - DNA, 15 bp, Homo sapiens
agccctggagaggaa

SEQ ID NO: 38893 - DNA, 15 bp, Homo sapiens
tagccctggagagga

SEQ ID NO: 38894 - DNA, 15 bp, Homo sapiens
ctagccctggagagg

SEQ ID NO: 38895 - DNA, 15 bp, Homo sapiens
cctagccctggagag

SEQ ID NO: 38896 - DNA, 15 bp, Homo sapiens
gcctagccctggaga

SEQ ID NO: 38897 - DNA, 15 bp, Homo sapiens
tgcctagccctggag

SEQ ID NO: 38898 - DNA, 15 bp, Homo sapiens
ttgcctagccctgga

SEQ ID NO: 38899 - DNA, 15 bp, Homo sapiens
cttgcctagccctgg

SEQ ID NO: 38900 - DNA, 15 bp, Homo sapiens
ccttgcctagccctg

SEQ ID NO: 38901 - DNA, 15 bp, Homo sapiens
gccttgcctagccct

SEQ ID NO: 38902 - DNA, 15 bp, Homo sapiens
tgccttgcctagccc

SEQ ID NO: 38903 - DNA, 15 bp, Homo sapiens
ctgccttgcctagcc

SEQ ID NO: 38904 - DNA, 15 bp, Homo sapiens
cctgccttgcctagc

SEQ ID NO: 38905 - DNA, 15 bp, Homo sapiens
gcctgccttgcctag

SEQ ID NO: 38906 - DNA, 15 bp, Homo sapiens
cgcctgccttgccta

SEQ ID NO: 38907 - DNA, 15 bp, Homo sapiens
tcgcctgccttgcct

SEQ ID NO: 38908 - DNA, 15 bp, Homo sapiens
ctcgcctgccttgcc

SEQ ID NO: 38909 - DNA, 15 bp, Homo sapiens
gctcgcctgccttgc

SEQ ID NO: 38910 - DNA, 15 bp, Homo sapiens
tgctcgcctgccttg

SEQ ID NO: 38911 - DNA, 15 bp, Homo sapiens
ctgctcgcctgcctt

SEQ ID NO: 38912 - DNA, 15 bp, Homo sapiens
gctgctcgcctgcct

SEQ ID NO: 38913 - DNA, 15 bp, Homo sapiens
ggctgctcgcctgcc

SEQ ID NO: 38914 - DNA, 15 bp, Homo sapiens
tggctgctcgcctgc

SEQ ID NO: 38915 - DNA, 15 bp, Homo sapiens
ctggctgctcgcctg

SEQ ID NO: 38916 - DNA, 15 bp, Homo sapiens
tctggctgctcgcct

SEQ ID NO: 38917 - DNA, 15 bp, Homo sapiens
ttctggctgctcgcc

SEQ ID NO: 38918 - DNA, 15 bp, Homo sapiens
cttctggctgctcgc

SEQ ID NO: 38919 - DNA, 15 bp, Homo sapiens
gcttctggctgctcg

SEQ ID NO: 38920 - DNA, 15 bp, Homo sapiens
ggcttctggctgctc

SEQ ID NO: 38921 - DNA, 15 bp, Homo sapiens
cggcttctggctgct

SEQ ID NO: 38922 - DNA, 15 bp, Homo sapiens
ccggcttctggctgc

SEQ ID NO: 38923 - DNA, 15 bp, Homo sapiens
cccggcttctggctg

SEQ ID NO: 38924 - DNA, 15 bp, Homo sapiens
acccggcttctggct

SEQ ID NO: 38925 - DNA, 15 bp, Homo sapiens
cacccggcttctggc

SEQ ID NO: 38926 - DNA, 15 bp, Homo sapiens
gcacccggcttctgg

SEQ ID NO: 38927 - DNA, 15 bp, Homo sapiens
ggcacccggcttctg

SEQ ID NO: 38928 - DNA, 15 bp, Homo sapiens
gggcacccggcttct

SEQ ID NO: 38929 - DNA, 15 bp, Homo sapiens
tgggcacccggcttc

SEQ ID NO: 38930 - DNA, 15 bp, Homo sapiens
gtgggcacccggctt

SEQ ID NO: 38931 - DNA, 15 bp, Homo sapiens
tgtgggcacccggct

SEQ ID NO: 38932 - DNA, 15 bp, Homo sapiens
ctgtgggcacccggc

SEQ ID NO: 38933 - DNA, 15 bp, Homo sapiens
cctgtgggcacccgg

SEQ ID NO: 38934 - DNA, 15 bp, Homo sapiens
ccctgtgggcacccg

SEQ ID NO: 38935 - DNA, 15 bp, Homo sapiens
gccctgtgggcaccc

SEQ ID NO: 38936 - DNA, 15 bp, Homo sapiens
tgccctgtgggcacc

SEQ ID NO: 38937 - DNA, 15 bp, Homo sapiens
ctgccctgtgggcac

SEQ ID NO: 38938 - DNA, 15 bp, Homo sapiens
cctgccctgtgggca

SEQ ID NO: 38939 - DNA, 15 bp, Homo sapiens
ccctgccctgtgggc

SEQ ID NO: 38940 - DNA, 15 bp, Homo sapiens
tccctgccctgtggg

SEQ ID NO: 38941 - DNA, 15 bp, Homo sapiens
gtccctgccctgtgg

SEQ ID NO: 38942 - DNA, 15 bp, Homo sapiens
tgtccctgccctgtg

SEQ ID NO: 38943 - DNA, 15 bp, Homo sapiens
ctgtccctgccctgt

SEQ ID NO: 38944 - DNA, 15 bp, Homo sapiens
cctgtccctgccctg

SEQ ID NO: 38945 - DNA, 15 bp, Homo sapiens
tcctgtccctgccct

SEQ ID NO: 38946 - DNA, 15 bp, Homo sapiens
ttcctgtccctgccc

SEQ ID NO: 38947 - DNA, 15 bp, Homo sapiens
cttcctgtccctgcc

SEQ ID NO: 38948 - DNA, 15 bp, Homo sapiens
ccttcctgtccctgc

SEQ ID NO: 38949 - DNA, 15 bp, Homo sapiens
gccttcctgtccctg

SEQ ID NO: 38950 - DNA, 15 bp, Homo sapiens
agccttcctgtccct

SEQ ID NO: 38951 - DNA, 15 bp, Homo sapiens
cagccttcctgtccc

SEQ ID NO: 38952 - DNA, 15 bp, Homo sapiens
acagccttcctgtcc

SEQ ID NO: 38953 - DNA, 15 bp, Homo sapiens
cacagccttcctgtc

SEQ ID NO: 38954 - DNA, 15 bp, Homo sapiens
gcacagccttcctgt

SEQ ID NO: 38955 - DNA, 15 bp, Homo sapiens
agcacagccttcctg

SEQ ID NO: 38956 - DNA, 15 bp, Homo sapiens
cagcacagccttcct

SEQ ID NO: 38957 - DNA, 15 bp, Homo sapiens
gcagcacagccttcc

SEQ ID NO: 38958 - DNA, 15 bp, Homo sapiens
agcagcacagccttc

SEQ ID NO: 38959 - DNA, 15 bp, Homo sapiens
tagcagcacagcctt

SEQ ID NO: 38960 - DNA, 15 bp, Homo sapiens
gtagcagcacagcct

SEQ ID NO: 38961 - DNA, 15 bp, Homo sapiens
agtagcagcacagcc

SEQ ID NO: 38962 - DNA, 15 bp, Homo sapiens
cagtagcagcacagc

SEQ ID NO: 38963 - DNA, 15 bp, Homo sapiens
ccagtagcagcacag

SEQ ID NO: 38964 - DNA, 15 bp, Homo sapiens
gccagtagcagcaca

SEQ ID NO: 38965 - DNA, 15 bp, Homo sapiens
agccagtagcagcac

SEQ ID NO: 38966 - DNA, 15 bp, Homo sapiens
cagccagtagcagca

SEQ ID NO: 38967 - DNA, 15 bp, Homo sapiens
gcagccagtagcagc

SEQ ID NO: 38968 - DNA, 15 bp, Homo sapiens
agcagccagtagcag

SEQ ID NO: 38969 - DNA, 15 bp, Homo sapiens
gagcagccagtagca

SEQ ID NO: 38970 - DNA, 15 bp, Homo sapiens
tgagcagccagtagc

SEQ ID NO: 38971 - DNA, 15 bp, Homo sapiens
gtgagcagccagtag

SEQ ID NO: 38972 - DNA, 15 bp, Homo sapiens
agtgagcagccagta

SEQ ID NO: 38973 - DNA, 15 bp, Homo sapiens
aagtgagcagccagt

SEQ ID NO: 38974 - DNA, 15 bp, Homo sapiens
gaagtgagcagccag

SEQ ID NO: 38975 - DNA, 15 bp, Homo sapiens
agaagtgagcagcca

SEQ ID NO: 38976 - DNA, 15 bp, Homo sapiens
gagaagtgagcagcc

SEQ ID NO: 38977 - DNA, 15 bp, Homo sapiens
ggagaagtgagcagc

SEQ ID NO: 38978 - DNA, 15 bp, Homo sapiens
tggagaagtgagcag

SEQ ID NO: 38979 - DNA, 15 bp, Homo sapiens
atggagaagtgagca

SEQ ID NO: 38980 - DNA, 15 bp, Homo sapiens
gatggagaagtgagc

SEQ ID NO: 38981 - DNA, 15 bp, Homo sapiens
tgatggagaagtgag

SEQ ID NO: 38982 - DNA, 15 bp, Homo sapiens
ttgatggagaagtga

SEQ ID NO: 38983 - DNA, 15 bp, Homo sapiens
gttgatggagaagtg

SEQ ID NO: 38984 - DNA, 15 bp, Homo sapiens
ggttgatggagaagt

SEQ ID NO: 38985 - DNA, 15 bp, Homo sapiens
aggttgatggagaag

SEQ ID NO: 38986 - DNA, 15 bp, Homo sapiens
gaggttgatggagaa

SEQ ID NO: 38987 - DNA, 15 bp, Homo sapiens
tgaggttgatggaga

SEQ ID NO: 38988 - DNA, 15 bp, Homo sapiens
gtgaggttgatggag

SEQ ID NO: 38989 - DNA, 15 bp, Homo sapiens
ggtgaggttgatgga

SEQ ID NO: 38990 - DNA, 15 bp, Homo sapiens
gggtgaggttgatgg

SEQ ID NO: 38991 - DNA, 15 bp, Homo sapiens
agggtgaggttgatg

SEQ ID NO: 38992 - DNA, 15 bp, Homo sapiens
gagggtgaggttgat

SEQ ID NO: 38993 - DNA, 15 bp, Homo sapiens
agagggtgaggttga

SEQ ID NO: 38994 - DNA, 15 bp, Homo sapiens
cagagggtgaggttg

SEQ ID NO: 38995 - DNA, 15 bp, Homo sapiens
gcagagggtgaggtt

SEQ ID NO: 38996 - DNA, 15 bp, Homo sapiens
tgcagagggtgaggt

SEQ ID NO: 38997 - DNA, 15 bp, Homo sapiens
gtgcagagggtgagg

SEQ ID NO: 38998 - DNA, 15 bp, Homo sapiens
ggtgcagagggtgag

SEQ ID NO: 38999 - DNA, 15 bp, Homo sapiens
tggtgcagagggtga

SEQ ID NO: 39000 - DNA, 15 bp, Homo sapiens
gtggtgcagagggtg

SEQ ID NO: 39001 - DNA, 15 bp, Homo sapiens
agtggtgcagagggt

SEQ ID NO: 39002 - DNA, 15 bp, Homo sapiens
tagtggtgcagaggg

SEQ ID NO: 39003 - DNA, 15 bp, Homo sapiens
ttagtggtgcagagg

SEQ ID NO: 39004 - DNA, 15 bp, Homo sapiens
gttagtggtgcagag

SEQ ID NO: 39005 - DNA, 15 bp, Homo sapiens
ggttagtggtgcaga

SEQ ID NO: 39006 - DNA, 15 bp, Homo sapiens
tggttagtggtgcag

SEQ ID NO: 39007 - DNA, 15 bp, Homo sapiens
ttggttagtggtgca

SEQ ID NO: 39008 - DNA, 15 bp, Homo sapiens
cttggttagtggtgc

SEQ ID NO: 39009 - DNA, 15 bp, Homo sapiens
tcttggttagtggtg

SEQ ID NO: 39010 - DNA, 15 bp, Homo sapiens
gtcttggttagtggt

SEQ ID NO: 39011 - DNA, 15 bp, Homo sapiens
ggtcttggttagtgg

SEQ ID NO: 39012 - DNA, 15 bp, Homo sapiens
aggtcttggttagtg

SEQ ID NO: 39013 - DNA, 15 bp, Homo sapiens
aaggtcttggttagt

SEQ ID NO: 39014 - DNA, 15 bp, Homo sapiens
caaggtcttggttag

SEQ ID NO: 39015 - DNA, 15 bp, Homo sapiens
acaaggtcttggtta

SEQ ID NO: 39016 - DNA, 15 bp, Homo sapiens
gacaaggtcttggtt

SEQ ID NO: 39017 - DNA, 15 bp, Homo sapiens
ggacaaggtcttggt

SEQ ID NO: 39018 - DNA, 15 bp, Homo sapiens
aggacaaggtcttgg

SEQ ID NO: 39019 - DNA, 15 bp, Homo sapiens
gaggacaaggtcttg

SEQ ID NO: 39020 - DNA, 15 bp, Homo sapiens
agaggacaaggtctt

SEQ ID NO: 39021 - DNA, 15 bp, Homo sapiens
aagaggacaaggtct

SEQ ID NO: 39022 - DNA, 15 bp, Homo sapiens
caagaggacaaggtc

SEQ ID NO: 39023 - DNA, 15 bp, Homo sapiens
gcaagaggacaaggt

SEQ ID NO: 39024 - DNA, 15 bp, Homo sapiens
ggcaagaggacaagg

SEQ ID NO: 39025 - DNA, 15 bp, Homo sapiens
aggcaagaggacaag

SEQ ID NO: 39026 - DNA, 15 bp, Homo sapiens
caggcaagaggacaa

SEQ ID NO: 39027 - DNA, 15 bp, Homo sapiens
acaggcaagaggaca

SEQ ID NO: 39028 - DNA, 15 bp, Homo sapiens
gacaggcaagaggac

SEQ ID NO: 39029 - DNA, 15 bp, Homo sapiens
agacaggcaagagga

SEQ ID NO: 39030 - DNA, 15 bp, Homo sapiens
gagacaggcaagagg

SEQ ID NO: 39031 - DNA, 15 bp, Homo sapiens
cgagacaggcaagag

SEQ ID NO: 39032 - DNA, 15 bp, Homo sapiens
gcgagacaggcaaga

SEQ ID NO: 39033 - DNA, 15 bp, Homo sapiens
agcgagacaggcaag

SEQ ID NO: 39034 - DNA, 15 bp, Homo sapiens
cagcgagacaggcaa

SEQ ID NO: 39035 - DNA, 15 bp, Homo sapiens
gcagcgagacaggca

SEQ ID NO: 39036 - DNA, 15 bp, Homo sapiens
agcagcgagacaggc

SEQ ID NO: 39037 - DNA, 15 bp, Homo sapiens
aagcagcgagacagg

SEQ ID NO: 39038 - DNA, 15 bp, Homo sapiens
aaagcagcgagacag

SEQ ID NO: 39039 - DNA, 15 bp, Homo sapiens
gaaagcagcgagaca

SEQ ID NO: 39040 - DNA, 15 bp, Homo sapiens
tgaaagcagcgagac

SEQ ID NO: 39041 - DNA, 15 bp, Homo sapiens
gtgaaagcagcgaga

SEQ ID NO: 39042 - DNA, 15 bp, Homo sapiens
tgtgaaagcagcgag

SEQ ID NO: 39043 - DNA, 15 bp, Homo sapiens
ctgtgaaagcagcga

SEQ ID NO: 39044 - DNA, 15 bp, Homo sapiens
gctgtgaaagcagcg

SEQ ID NO: 39045 - DNA, 15 bp, Homo sapiens
agctgtgaaagcagc

SEQ ID NO: 39046 - DNA, 15 bp, Homo sapiens
cagctgtgaaagcag

SEQ ID NO: 39047 - DNA, 15 bp, Homo sapiens
gcagctgtgaaagca

SEQ ID NO: 39048 - DNA, 15 bp, Homo sapiens
tgcagctgtgaaagc

SEQ ID NO: 39049 - DNA, 15 bp, Homo sapiens
ttgcagctgtgaaag

SEQ ID NO: 39050 - DNA, 15 bp, Homo sapiens
gttgcagctgtgaaa

SEQ ID NO: 39051 - DNA, 15 bp, Homo sapiens
cgttgcagctgtgaa

SEQ ID NO: 39052 - DNA, 15 bp, Homo sapiens
tcgttgcagctgtga

SEQ ID NO: 39053 - DNA, 15 bp, Homo sapiens
atcgttgcagctgtg

SEQ ID NO: 39054 - DNA, 15 bp, Homo sapiens
aatcgttgcagctgt

SEQ ID NO: 39055 - DNA, 15 bp, Homo sapiens
caatcgttgcagctg

SEQ ID NO: 39056 - DNA, 15 bp, Homo sapiens
acaatcgttgcagct

SEQ ID NO: 39057 - DNA, 15 bp, Homo sapiens
cacaatcgttgcagc

SEQ ID NO: 39058 - DNA, 15 bp, Homo sapiens
acacaatcgttgcag

SEQ ID NO: 39059 - DNA, 15 bp, Homo sapiens
gacacaatcgttgca

SEQ ID NO: 39060 - DNA, 15 bp, Homo sapiens
agacacaatcgttgc

SEQ ID NO: 39061 - DNA, 15 bp, Homo sapiens
cagacacaatcgttg

SEQ ID NO: 39062 - DNA, 15 bp, Homo sapiens
gcagacacaatcgtt

SEQ ID NO: 39063 - DNA, 15 bp, Homo sapiens
ggcagacacaatcgt

SEQ ID NO: 39064 - DNA, 15 bp, Homo sapiens
aggcagacacaatcg

SEQ ID NO: 39065 - DNA, 15 bp, Homo sapiens
gaggcagacacaatc

SEQ ID NO: 39066 - DNA, 15 bp, Homo sapiens
tgaggcagacacaat

SEQ ID NO: 39067 - DNA, 15 bp, Homo sapiens
atgaggcagacacaa

SEQ ID NO: 39068 - DNA, 15 bp, Homo sapiens
catgaggcagacaca

SEQ ID NO: 39069 - DNA, 15 bp, Homo sapiens
ccatgaggcagacac

SEQ ID NO: 39070 - DNA, 15 bp, Homo sapiens
cccatgaggcagaca

SEQ ID NO: 39071 - DNA, 15 bp, Homo sapiens
ccccatgaggcagac

SEQ ID NO: 39072 - DNA, 15 bp, Homo sapiens
accccatgaggcaga

SEQ ID NO: 39073 - DNA, 15 bp, Homo sapiens
aaccccatgaggcag

SEQ ID NO: 39074 - DNA, 15 bp, Homo sapiens
aaaccccatgaggca

SEQ ID NO: 39075 - DNA, 15 bp, Homo sapiens
aaaaccccatgaggc

SEQ ID NO: 39076 - DNA, 15 bp, Homo sapiens
gaaaaccccatgagg

SEQ ID NO: 39077 - DNA, 15 bp, Homo sapiens
ggaaaaccccatgag

SEQ ID NO: 39078 - DNA, 15 bp, Homo sapiens
aggaaaaccccatga

SEQ ID NO: 39079 - DNA, 15 bp, Homo sapiens
gaggaaaaccccatg

SEQ ID NO: 39080 - DNA, 15 bp, Homo sapiens
ggaggaaaaccccat

SEQ ID NO: 39081 - DNA, 15 bp, Homo sapiens
tggaggaaaacccca

SEQ ID NO: 39082 - DNA, 15 bp, Homo sapiens
ctggaggaaaacccc

SEQ ID NO: 39083 - DNA, 15 bp, Homo sapiens
tctggaggaaaaccc

SEQ ID NO: 39084 - DNA, 15 bp, Homo sapiens
ctctggaggaaaacc

SEQ ID NO: 39085 - DNA, 15 bp, Homo sapiens
gctctggaggaaaac

SEQ ID NO: 39086 - DNA, 15 bp, Homo sapiens
ggctctggaggaaaa

SEQ ID NO: 39087 - DNA, 15 bp, Homo sapiens
aggctctggaggaaa

SEQ ID NO: 39088 - DNA, 15 bp, Homo sapiens
aaggctctggaggaa

SEQ ID NO: 39089 - DNA, 15 bp, Homo sapiens
aaaggctctggagga

SEQ ID NO: 39090 - DNA, 15 bp, Homo sapiens
taaaggctctggagg

SEQ ID NO: 39091 - DNA, 15 bp, Homo sapiens
ataaaggctctggag

SEQ ID NO: 39092 - DNA, 15 bp, Homo sapiens
aataaaggctctgga

SEQ ID NO: 39093 - DNA, 15 bp, Homo sapiens
gaataaaggctctgg

SEQ ID NO: 39094 - DNA, 15 bp, Homo sapiens
agaataaaggctctg

SEQ ID NO: 39095 - DNA, 15 bp, Homo sapiens
cagaataaaggctct

SEQ ID NO: 39096 - DNA, 15 bp, Homo sapiens
acagaataaaggctc

SEQ ID NO: 39097 - DNA, 15 bp, Homo sapiens
tacagaataaaggct

SEQ ID NO: 39098 - DNA, 15 bp, Homo sapiens
ctacagaataaaggc

SEQ ID NO: 39099 - DNA, 15 bp, Homo sapiens
gctacagaataaagg

SEQ ID NO: 39100 - DNA, 15 bp, Homo sapiens
ggctacagaataaag

SEQ ID NO: 39101 - DNA, 15 bp, Homo sapiens
tggctacagaataaa

SEQ ID NO: 39102 - DNA, 15 bp, Homo sapiens
ctggctacagaataa

SEQ ID NO: 39103 - DNA, 15 bp, Homo sapiens
tctggctacagaata

SEQ ID NO: 39104 - DNA, 15 bp, Homo sapiens
gtctggctacagaat

SEQ ID NO: 39105 - DNA, 15 bp, Homo sapiens
cgtctggctacagaa

SEQ ID NO: 39106 - DNA, 15 bp, Homo sapiens
tcgtctggctacaga

SEQ ID NO: 39107 - DNA, 15 bp, Homo sapiens
gtcgtctggctacag

SEQ ID NO: 39108 - DNA, 15 bp, Homo sapiens
tgtcgtctggctaca

SEQ ID NO: 39109 - DNA, 15 bp, Homo sapiens
gtgtcgtctggctac

SEQ ID NO: 39110 - DNA, 15 bp, Homo sapiens
cgtgtcgtctggcta

SEQ ID NO: 39111 - DNA, 15 bp, Homo sapiens
tcgtgtcgtctggct

SEQ ID NO: 39112 - DNA, 15 bp, Homo sapiens
ctcgtgtcgtctggc

SEQ ID NO: 39113 - DNA, 15 bp, Homo sapiens
cctcgtgtcgtctgg

SEQ ID NO: 39114 - DNA, 15 bp, Homo sapiens
tcctcgtgtcgtctg

SEQ ID NO: 39115 - DNA, 15 bp, Homo sapiens
ctcctcgtgtcgtct

SEQ ID NO: 39116 - DNA, 15 bp, Homo sapiens
actcctcgtgtcgtc

SEQ ID NO: 39117 - DNA, 15 bp, Homo sapiens
gactcctcgtgtcgt

SEQ ID NO: 39118 - DNA, 15 bp, Homo sapiens
agactcctcgtgtcg

SEQ ID NO: 39119 - DNA, 15 bp, Homo sapiens
cagactcctcgtgtc

SEQ ID NO: 39120 - DNA, 15 bp, Homo sapiens
acagactcctcgtgt

SEQ ID NO: 39121 - DNA, 15 bp, Homo sapiens
cacagactcctcgtg

SEQ ID NO: 39122 - DNA, 15 bp, Homo sapiens
acacagactcctcgt

SEQ ID NO: 39123 - DNA, 15 bp, Homo sapiens
gacacagactcctcg

SEQ ID NO: 39124 - DNA, 15 bp, Homo sapiens
tgacacagactcctc

SEQ ID NO: 39125 - DNA, 15 bp, Homo sapiens
gtgacacagactcct

SEQ ID NO: 39126 - DNA, 15 bp, Homo sapiens
agtgacacagactcc

SEQ ID NO: 39127 - DNA, 15 bp, Homo sapiens
cagtgacacagactc

SEQ ID NO: 39128 - DNA, 15 bp, Homo sapiens
tcagtgacacagact

SEQ ID NO: 39129 - DNA, 15 bp, Homo sapiens
ctcagtgacacagac

SEQ ID NO: 39130 - DNA, 15 bp, Homo sapiens
gctcagtgacacaga

SEQ ID NO: 39131 - DNA, 15 bp, Homo sapiens
ggctcagtgacacag

SEQ ID NO: 39132 - DNA, 15 bp, Homo sapiens
tggctcagtgacaca

SEQ ID NO: 39133 - DNA, 15 bp, Homo sapiens
ctggctcagtgacac

SEQ ID NO: 39134 - DNA, 15 bp, Homo sapiens
actggctcagtgaca

SEQ ID NO: 39135 - DNA, 15 bp, Homo sapiens
cactggctcagtgac

SEQ ID NO: 39136 - DNA, 15 bp, Homo sapiens
gcactggctcagtga

SEQ ID NO: 39137 - DNA, 15 bp, Homo sapiens
agcactggctcagtg

SEQ ID NO: 39138 - DNA, 15 bp, Homo sapiens
aagcactggctcagt

SEQ ID NO: 39139 - DNA, 15 bp, Homo sapiens
gaagcactggctcag

SEQ ID NO: 39140 - DNA, 15 bp, Homo sapiens
agaagcactggctca

SEQ ID NO: 39141 - DNA, 15 bp, Homo sapiens
tagaagcactggctc

SEQ ID NO: 39142 - DNA, 15 bp, Homo sapiens
ctagaagcactggct

SEQ ID NO: 39143 - DNA, 15 bp, Homo sapiens
tctagaagcactggc

SEQ ID NO: 39144 - DNA, 15 bp, Homo sapiens
atctagaagcactgg

SEQ ID NO: 39145 - DNA, 15 bp, Homo sapiens
catctagaagcactg

SEQ ID NO: 39146 - DNA, 15 bp, Homo sapiens
gcatctagaagcact

SEQ ID NO: 39147 - DNA, 15 bp, Homo sapiens
agcatctagaagcac

SEQ ID NO: 39148 - DNA, 15 bp, Homo sapiens
tagcatctagaagca

SEQ ID NO: 39149 - DNA, 15 bp, Homo sapiens
gtagcatctagaagc

SEQ ID NO: 39150 - DNA, 15 bp, Homo sapiens
ggtagcatctagaag

SEQ ID NO: 39151 - DNA, 15 bp, Homo sapiens
gggtagcatctagaa

SEQ ID NO: 39152 - DNA, 15 bp, Homo sapiens
agggtagcatctaga

SEQ ID NO: 39153 - DNA, 15 bp, Homo sapiens
cagggtagcatctag

SEQ ID NO: 39154 - DNA, 15 bp, Homo sapiens
acagggtagcatcta

SEQ ID NO: 39155 - DNA, 15 bp, Homo sapiens
cacagggtagcatct

SEQ ID NO: 39156 - DNA, 15 bp, Homo sapiens
acacagggtagcatc

SEQ ID NO: 39157 - DNA, 15 bp, Homo sapiens
cacacagggtagcat

SEQ ID NO: 39158 - DNA, 15 bp, Homo sapiens
ccacacagggtagca

SEQ ID NO: 39159 - DNA, 15 bp, Homo sapiens
cccacacagggtagc

SEQ ID NO: 39160 - DNA, 15 bp, Homo sapiens
gcccacacagggtag

SEQ ID NO: 39161 - DNA, 15 bp, Homo sapiens
cgcccacacagggta

SEQ ID NO: 39162 - DNA, 15 bp, Homo sapiens
ccgcccacacagggt

SEQ ID NO: 39163 - DNA, 15 bp, Homo sapiens
gccgcccacacaggg

SEQ ID NO: 39164 - DNA, 15 bp, Homo sapiens
tgccgcccacacagg

SEQ ID NO: 39165 - DNA, 15 bp, Homo sapiens
gtgccgcccacacag

SEQ ID NO: 39166 - DNA, 15 bp, Homo sapiens
ggtgccgcccacaca

SEQ ID NO: 39167 - DNA, 15 bp, Homo sapiens
aggtgccgcccacac

SEQ ID NO: 39168 - DNA, 15 bp, Homo sapiens
gaggtgccgcccaca

SEQ ID NO: 39169 - DNA, 15 bp, Homo sapiens
tgaggtgccgcccac

SEQ ID NO: 39170 - DNA, 15 bp, Homo sapiens
ctgaggtgccgccca

SEQ ID NO: 39171 - DNA, 15 bp, Homo sapiens
cctgaggtgccgccc

SEQ ID NO: 39172 - DNA, 15 bp, Homo sapiens
ccctgaggtgccgcc

SEQ ID NO: 39173 - DNA, 15 bp, Homo sapiens
tccctgaggtgccgc

SEQ ID NO: 39174 - DNA, 15 bp, Homo sapiens
gtccctgaggtgccg

SEQ ID NO: 39175 - DNA, 15 bp, Homo sapiens
tgtccctgaggtgcc

SEQ ID NO: 39176 - DNA, 15 bp, Homo sapiens
ctgtccctgaggtgc

SEQ ID NO: 39177 - DNA, 15 bp, Homo sapiens
actgtccctgaggtg

SEQ ID NO: 39178 - DNA, 15 bp, Homo sapiens
tactgtccctgaggt

SEQ ID NO: 39179 - DNA, 15 bp, Homo sapiens
ttactgtccctgagg

SEQ ID NO: 39180 - DNA, 15 bp, Homo sapiens
tttactgtccctgag

SEQ ID NO: 39181 - DNA, 15 bp, Homo sapiens
atttactgtccctga

SEQ ID NO: 39182 - DNA, 15 bp, Homo sapiens
gatttactgtccctg

SEQ ID NO: 39183 - DNA, 15 bp, Homo sapiens
tgatttactgtccct

SEQ ID NO: 39184 - DNA, 15 bp, Homo sapiens
ctgatttactgtccc

SEQ ID NO: 39185 - DNA, 15 bp, Homo sapiens
tctgatttactgtcc

SEQ ID NO: 39186 - DNA, 15 bp, Homo sapiens
ttctgatttactgtc

SEQ ID NO: 39187 - DNA, 15 bp, Homo sapiens
tttctgatttactgt

SEQ ID NO: 39188 - DNA, 15 bp, Homo sapiens
atttctgatttactg

SEQ ID NO: 39189 - DNA, 15 bp, Homo sapiens
catttctgatttact

SEQ ID NO: 39190 - DNA, 15 bp, Homo sapiens
gcatttctgatttac

SEQ ID NO: 39191 - DNA, 15 bp, Homo sapiens
agcatttctgattta

SEQ ID NO: 39192 - DNA, 15 bp, Homo sapiens
cagcatttctgattt

SEQ ID NO: 39193 - DNA, 15 bp, Homo sapiens
ccagcatttctgatt

SEQ ID NO: 39194 - DNA, 15 bp, Homo sapiens
accagcatttctgat

SEQ ID NO: 39195 - DNA, 15 bp, Homo sapiens
gaccagcatttctga

SEQ ID NO: 39196 - DNA, 15 bp, Homo sapiens
agaccagcatttctg

SEQ ID NO: 39197 - DNA, 15 bp, Homo sapiens
aagaccagcatttct

SEQ ID NO: 39198 - DNA, 15 bp, Homo sapiens
caagaccagcatttc

SEQ ID NO: 39199 - DNA, 15 bp, Homo sapiens
tcaagaccagcattt

SEQ ID NO: 39200 - DNA, 15 bp, Homo sapiens
ttcaagaccagcatt

SEQ ID NO: 39201 - DNA, 15 bp, Homo sapiens
tttcaagaccagcat

SEQ ID NO: 39202 - DNA, 15 bp, Homo sapiens
gtttcaagaccagca

SEQ ID NO: 39203 - DNA, 15 bp, Homo sapiens
ggtttcaagaccagc

SEQ ID NO: 39204 - DNA, 15 bp, Homo sapiens
aggtttcaagaccag

SEQ ID NO: 39205 - DNA, 15 bp, Homo sapiens
aaggtttcaagacca

SEQ ID NO: 39206 - DNA, 15 bp, Homo sapiens
caaggtttcaagacc

SEQ ID NO: 39207 - DNA, 15 bp, Homo sapiens
tcaaggtttcaagac

SEQ ID NO: 39208 - DNA, 15 bp, Homo sapiens
ttcaaggtttcaaga

SEQ ID NO: 39209 - DNA, 15 bp, Homo sapiens
tttcaaggtttcaag

SEQ ID NO: 39210 - DNA, 15 bp, Homo sapiens
ttttcaaggtttcaa

SEQ ID NO: 39211 - DNA, 15 bp, Homo sapiens
cttttcaaggtttca

SEQ ID NO: 39212 - DNA, 15 bp, Homo sapiens
tcttttcaaggtttc

SEQ ID NO: 39213 - DNA, 15 bp, Homo sapiens
atcttttcaaggttt

SEQ ID NO: 39214 - DNA, 15 bp, Homo sapiens
gatcttttcaaggtt

SEQ ID NO: 39215 - DNA, 15 bp, Homo sapiens
tgatcttttcaaggt

SEQ ID NO: 39216 - DNA, 15 bp, Homo sapiens
ttgatcttttcaagg

SEQ ID NO: 39217 - DNA, 15 bp, Homo sapiens
cttgatcttttcaag

SEQ ID NO: 39218 - DNA, 15 bp, Homo sapiens
gcttgatcttttcaa

SEQ ID NO: 39219 - DNA, 15 bp, Homo sapiens
agcttgatcttttca

SEQ ID NO: 39220 - DNA, 15 bp, Homo sapiens
cagcttgatcttttc

SEQ ID NO: 39221 - DNA, 15 bp, Homo sapiens
tcagcttgatctttt

SEQ ID NO: 39222 - DNA, 15 bp, Homo sapiens
ttcagcttgatcttt

SEQ ID NO: 39223 - DNA, 15 bp, Homo sapiens
attcagcttgatctt

SEQ ID NO: 39224 - DNA, 15 bp, Homo sapiens
cattcagcttgatct

SEQ ID NO: 39225 - DNA, 15 bp, Homo sapiens
acattcagcttgatc

SEQ ID NO: 39226 - DNA, 15 bp, Homo sapiens
aacattcagcttgat

SEQ ID NO: 39227 - DNA, 15 bp, Homo sapiens
gaacattcagcttga

SEQ ID NO: 39228 - DNA, 15 bp, Homo sapiens
ggaacattcagcttg

SEQ ID NO: 39229 - DNA, 15 bp, Homo sapiens
aggaacattcagctt

SEQ ID NO: 39230 - DNA, 15 bp, Homo sapiens
aaggaacattcagct

SEQ ID NO: 39231 - DNA, 15 bp, Homo sapiens
aaaggaacattcagc

SEQ ID NO: 39232 - DNA, 15 bp, Homo sapiens
aaaaggaacattcag

SEQ ID NO: 39233 - DNA, 15 bp, Homo sapiens
gaaaaggaacattca

SEQ ID NO: 39234 - DNA, 15 bp, Homo sapiens
tgaaaaggaacattc

SEQ ID NO: 39235 - DNA, 15 bp, Homo sapiens
atgaaaaggaacatt

SEQ ID NO: 39236 - DNA, 15 bp, Homo sapiens
gatgaaaaggaacat

SEQ ID NO: 39237 - DNA, 15 bp, Homo sapiens
agatgaaaaggaaca

SEQ ID NO: 39238 - DNA, 15 bp, Homo sapiens
cagatgaaaaggaac

SEQ ID NO: 39239 - DNA, 15 bp, Homo sapiens
acagatgaaaaggaa

SEQ ID NO: 39240 - DNA, 15 bp, Homo sapiens
gacagatgaaaagga

SEQ ID NO: 39241 - DNA, 15 bp, Homo sapiens
cgacagatgaaaagg

SEQ ID NO: 39242 - DNA, 15 bp, Homo sapiens
gcgacagatgaaaag

SEQ ID NO: 39243 - DNA, 15 bp, Homo sapiens
agcgacagatgaaaa

SEQ ID NO: 39244 - DNA, 15 bp, Homo sapiens
cagcgacagatgaaa

SEQ ID NO: 39245 - DNA, 15 bp, Homo sapiens
acagcgacagatgaa

SEQ ID NO: 39246 - DNA, 15 bp, Homo sapiens
aacagcgacagatga

SEQ ID NO: 39247 - DNA, 15 bp, Homo sapiens
caacagcgacagatg

SEQ ID NO: 39248 - DNA, 15 bp, Homo sapiens
tcaacagcgacagat

SEQ ID NO: 39249 - DNA, 15 bp, Homo sapiens
atcaacagcgacaga

SEQ ID NO: 39250 - DNA, 15 bp, Homo sapiens
gatcaacagcgacag

SEQ ID NO: 39251 - DNA, 15 bp, Homo sapiens
agatcaacagcgaca

SEQ ID NO: 39252 - DNA, 15 bp, Homo sapiens
aagatcaacagcgac

SEQ ID NO: 39253 - DNA, 15 bp, Homo sapiens
gaagatcaacagcga

SEQ ID NO: 39254 - DNA, 15 bp, Homo sapiens
tgaagatcaacagcg

SEQ ID NO: 39255 - DNA, 15 bp, Homo sapiens
atgaagatcaacagc

SEQ ID NO: 39256 - DNA, 15 bp, Homo sapiens
gatgaagatcaacag

SEQ ID NO: 39257 - DNA, 15 bp, Homo sapiens
agatgaagatcaaca

SEQ ID NO: 39258 - DNA, 15 bp, Homo sapiens
tagatgaagatcaac

SEQ ID NO: 39259 - DNA, 15 bp, Homo sapiens
atagatgaagatcaa

SEQ ID NO: 39260 - DNA, 15 bp, Homo sapiens
aatagatgaagatca

SEQ ID NO: 39261 - DNA, 15 bp, Homo sapiens
aaatagatgaagatc

SEQ ID NO: 39262 - DNA, 15 bp, Homo sapiens
taaatagatgaagat

SEQ ID NO: 39263 - DNA, 15 bp, Homo sapiens
ttaaatagatgaaga

SEQ ID NO: 39264 - DNA, 15 bp, Homo sapiens
tttaaatagatgaag

SEQ ID NO: 39265 - DNA, 15 bp, Homo sapiens
atttaaatagatgaa

SEQ ID NO: 39266 - DNA, 15 bp, Homo sapiens
tatttaaatagatga

SEQ ID NO: 39267 - DNA, 15 bp, Homo sapiens
ctatttaaatagatg

SEQ ID NO: 39268 - DNA, 15 bp, Homo sapiens
cctatttaaatagat

SEQ ID NO: 39269 - DNA, 15 bp, Homo sapiens
acctatttaaataga

SEQ ID NO: 39270 - DNA, 15 bp, Homo sapiens
tacctatttaaatag

SEQ ID NO: 39271 - DNA, 15 bp, Homo sapiens
atacctatttaaata

SEQ ID NO: 39272 - DNA, 15 bp, Homo sapiens
aatacctatttaaat

SEQ ID NO: 39273 - DNA, 15 bp, Homo sapiens
gaatacctatttaaa

SEQ ID NO: 39274 - DNA, 15 bp, Homo sapiens
agaatacctatttaa

SEQ ID NO: 39275 - DNA, 15 bp, Homo sapiens
tagaatacctattta

SEQ ID NO: 39276 - DNA, 15 bp, Homo sapiens
ttagaatacctattt

SEQ ID NO: 39277 - DNA, 15 bp, Homo sapiens
gttagaatacctatt

SEQ ID NO: 39278 - DNA, 15 bp, Homo sapiens
cgttagaatacctat

SEQ ID NO: 39279 - DNA, 15 bp, Homo sapiens
acgttagaataccta

SEQ ID NO: 39280 - DNA, 15 bp, Homo sapiens
aacgttagaatacct

SEQ ID NO: 39281 - DNA, 15 bp, Homo sapiens
aaacgttagaatacc

SEQ ID NO: 39282 - DNA, 15 bp, Homo sapiens
gaaacgttagaatac

SEQ ID NO: 39283 - DNA, 15 bp, Homo sapiens
ggaaacgttagaata

SEQ ID NO: 39284 - DNA, 15 bp, Homo sapiens
aggaaacgttagaat

SEQ ID NO: 39285 - DNA, 15 bp, Homo sapiens
gaggaaacgttagaa

SEQ ID NO: 39286 - DNA, 15 bp, Homo sapiens
agaggaaacgttaga

SEQ ID NO: 39287 - DNA, 15 bp, Homo sapiens
gagaggaaacgttag

SEQ ID NO: 39288 - DNA, 15 bp, Homo sapiens
agagaggaaacgtta

SEQ ID NO: 39289 - DNA, 15 bp, Homo sapiens
cagagaggaaacgtt

SEQ ID NO: 39290 - DNA, 15 bp, Homo sapiens
acagagaggaaacgt

SEQ ID NO: 39291 - DNA, 15 bp, Homo sapiens
tacagagaggaaacg

SEQ ID NO: 39292 - DNA, 15 bp, Homo sapiens
atacagagaggaaac

SEQ ID NO: 39293 - DNA, 15 bp, Homo sapiens
aatacagagaggaaa

SEQ ID NO: 39294 - DNA, 15 bp, Homo sapiens
aaatacagagaggaa

SEQ ID NO: 39295 - DNA, 15 bp, Homo sapiens
gaaatacagagagga

SEQ ID NO: 39296 - DNA, 15 bp, Homo sapiens
tgaaatacagagagg

SEQ ID NO: 39297 - DNA, 15 bp, Homo sapiens
atgaaatacagagag

SEQ ID NO: 39298 - DNA, 15 bp, Homo sapiens
catgaaatacagaga

SEQ ID NO: 39299 - DNA, 15 bp, Homo sapiens
tcatgaaatacagag

SEQ ID NO: 39300 - DNA, 15 bp, Homo sapiens
ttcatgaaatacaga

SEQ ID NO: 39301 - DNA, 15 bp, Homo sapiens
cttcatgaaatacag

SEQ ID NO: 39302 - DNA, 15 bp, Homo sapiens
gcttcatgaaataca

SEQ ID NO: 39303 - DNA, 15 bp, Homo sapiens
agcttcatgaaatac

SEQ ID NO: 39304 - DNA, 15 bp, Homo sapiens
cagcttcatgaaata

SEQ ID NO: 39305 - DNA, 15 bp, Homo sapiens
tcagcttcatgaaat

SEQ ID NO: 39306 - DNA, 15 bp, Homo sapiens
atcagcttcatgaaa

SEQ ID NO: 39307 - DNA, 15 bp, Homo sapiens
aatcagcttcatgaa

SEQ ID NO: 39308 - DNA, 15 bp, Homo sapiens
aaatcagcttcatga

SEQ ID NO: 39309 - DNA, 15 bp, Homo sapiens
gaaatcagcttcatg

SEQ ID NO: 39310 - DNA, 15 bp, Homo sapiens
ggaaatcagcttcat

SEQ ID NO: 39311 - DNA, 15 bp, Homo sapiens
aggaaatcagcttca

SEQ ID NO: 39312 - DNA, 15 bp, Homo sapiens
gaggaaatcagcttc

SEQ ID NO: 39313 - DNA, 15 bp, Homo sapiens
agaggaaatcagctt

SEQ ID NO: 39314 - DNA, 15 bp, Homo sapiens
gagaggaaatcagct

SEQ ID NO: 39315 - DNA, 15 bp, Homo sapiens
agagaggaaatcagc

SEQ ID NO: 39316 - DNA, 15 bp, Homo sapiens
gagagaggaaatcag

SEQ ID NO: 39317 - DNA, 15 bp, Homo sapiens
agagagaggaaatca

SEQ ID NO: 39318 - DNA, 15 bp, Homo sapiens
aagagagaggaaatc

SEQ ID NO: 39319 - DNA, 15 bp, Homo sapiens
aaagagagaggaaat

SEQ ID NO: 39320 - DNA, 15 bp, Homo sapiens
gaaagagagaggaaa

SEQ ID NO: 39321 - DNA, 15 bp, Homo sapiens
ggaaagagagaggaa

SEQ ID NO: 39322 - DNA, 15 bp, Homo sapiens
aggaaagagagagga

SEQ ID NO: 39323 - DNA, 15 bp, Homo sapiens
aaggaaagagagagg

SEQ ID NO: 39324 - DNA, 15 bp, Homo sapiens
aaaggaaagagagag

SEQ ID NO: 39325 - DNA, 15 bp, Homo sapiens
aaaaggaaagagaga

SEQ ID NO: 39326 - DNA, 15 bp, Homo sapiens
gaaaaggaaagagag

SEQ ID NO: 39327 - DNA, 15 bp, Homo sapiens
tgaaaaggaaagaga

SEQ ID NO: 39328 - DNA, 15 bp, Homo sapiens
ctgaaaaggaaagag

SEQ ID NO: 39329 - DNA, 15 bp, Homo sapiens
gctgaaaaggaaaga

SEQ ID NO: 39330 - DNA, 15 bp, Homo sapiens
tgctgaaaaggaaag

SEQ ID NO: 39331 - DNA, 15 bp, Homo sapiens
ttgctgaaaaggaaa

SEQ ID NO: 39332 - DNA, 15 bp, Homo sapiens
attgctgaaaaggaa

SEQ ID NO: 39333 - DNA, 15 bp, Homo sapiens
tattgctgaaaagga

SEQ ID NO: 39334 - DNA, 15 bp, Homo sapiens
gtattgctgaaaagg

SEQ ID NO: 39335 - DNA, 15 bp, Homo sapiens
agtattgctgaaaag

SEQ ID NO: 39336 - DNA, 15 bp, Homo sapiens
cagtattgctgaaaa

SEQ ID NO: 39337 - DNA, 15 bp, Homo sapiens
ccagtattgctgaaa

SEQ ID NO: 39338 - DNA, 15 bp, Homo sapiens
tccagtattgctgaa

SEQ ID NO: 39339 - DNA, 15 bp, Homo sapiens
ctccagtattgctga

SEQ ID NO: 39340 - DNA, 15 bp, Homo sapiens
actccagtattgctg

SEQ ID NO: 39341 - DNA, 15 bp, Homo sapiens
tactccagtattgct

SEQ ID NO: 39342 - DNA, 15 bp, Homo sapiens
ttactccagtattgc

SEQ ID NO: 39343 - DNA, 15 bp, Homo sapiens
gttactccagtattg

SEQ ID NO: 39344 - DNA, 15 bp, Homo sapiens
ggttactccagtatt

SEQ ID NO: 39345 - DNA, 15 bp, Homo sapiens
cggttactccagtat

SEQ ID NO: 39346 - DNA, 15 bp, Homo sapiens
gcggttactccagta

SEQ ID NO: 39347 - DNA, 15 bp, Homo sapiens
agcggttactccagt

SEQ ID NO: 39348 - DNA, 15 bp, Homo sapiens
aagcggttactccag

SEQ ID NO: 39349 - DNA, 15 bp, Homo sapiens
gaagcggttactcca

SEQ ID NO: 39350 - DNA, 15 bp, Homo sapiens
ggaagcggttactcc

SEQ ID NO: 39351 - DNA, 15 bp, Homo sapiens
aggaagcggttactc

SEQ ID NO: 39352 - DNA, 15 bp, Homo sapiens
taggaagcggttact

SEQ ID NO: 39353 - DNA, 15 bp, Homo sapiens
ttaggaagcggttac

SEQ ID NO: 39354 - DNA, 15 bp, Homo sapiens
tttaggaagcggtta

SEQ ID NO: 39355 - DNA, 15 bp, Homo sapiens
gtttaggaagcggtt

SEQ ID NO: 39356 - DNA, 15 bp, Homo sapiens
ggtttaggaagcggt

SEQ ID NO: 39357 - DNA, 15 bp, Homo sapiens
tggtttaggaagcgg

SEQ ID NO: 39358 - DNA, 15 bp, Homo sapiens
atggtttaggaagcg

SEQ ID NO: 39359 - DNA, 15 bp, Homo sapiens
aatggtttaggaagc

SEQ ID NO: 39360 - DNA, 15 bp, Homo sapiens
aaatggtttaggaag

SEQ ID NO: 39361 - DNA, 15 bp, Homo sapiens
aaaatggtttaggaa

SEQ ID NO: 39362 - DNA, 15 bp, Homo sapiens
caaaatggtttagga

SEQ ID NO: 39363 - DNA, 15 bp, Homo sapiens
gcaaaatggtttagg

SEQ ID NO: 39364 - DNA, 15 bp, Homo sapiens
tgcaaaatggtttag

SEQ ID NO: 39365 - DNA, 15 bp, Homo sapiens
ctgcaaaatggttta

SEQ ID NO: 39366 - DNA, 15 bp, Homo sapiens
tctgcaaaatggttt

SEQ ID NO: 39367 - DNA, 15 bp, Homo sapiens
ttctgcaaaatggtt

SEQ ID NO: 39368 - DNA, 15 bp, Homo sapiens
tttctgcaaaatggt

SEQ ID NO: 39369 - DNA, 15 bp, Homo sapiens
atttctgcaaaatgg

SEQ ID NO: 39370 - DNA, 15 bp, Homo sapiens
catttctgcaaaatg

SEQ ID NO: 39371 - DNA, 15 bp, Homo sapiens
acatttctgcaaaat

SEQ ID NO: 39372 - DNA, 15 bp, Homo sapiens
tacatttctgcaaaa

SEQ ID NO: 39373 - DNA, 15 bp, Homo sapiens
ttacatttctgcaaa

SEQ ID NO: 39374 - DNA, 15 bp, Homo sapiens
cttacatttctgcaa

SEQ ID NO: 39375 - DNA, 15 bp, Homo sapiens
ccttacatttctgca

SEQ ID NO: 39376 - DNA, 15 bp, Homo sapiens
cccttacatttctgc

SEQ ID NO: 39377 - DNA, 15 bp, Homo sapiens
acccttacatttctg

SEQ ID NO: 39378 - DNA, 15 bp, Homo sapiens
cacccttacatttct

SEQ ID NO: 39379 - DNA, 15 bp, Homo sapiens
acacccttacatttc

SEQ ID NO: 39380 - DNA, 15 bp, Homo sapiens
aacacccttacattt

SEQ ID NO: 39381 - DNA, 15 bp, Homo sapiens
gaacacccttacatt

SEQ ID NO: 39382 - DNA, 15 bp, Homo sapiens
cgaacacccttacat

SEQ ID NO: 39383 - DNA, 15 bp, Homo sapiens
ccgaacacccttaca

SEQ ID NO: 39384 - DNA, 15 bp, Homo sapiens
accgaacacccttac

SEQ ID NO: 39385 - DNA, 15 bp, Homo sapiens
aaccgaacaccctta

SEQ ID NO: 39386 - DNA, 15 bp, Homo sapiens
caaccgaacaccctt

SEQ ID NO: 39387 - DNA, 15 bp, Homo sapiens
gcaaccgaacaccct

SEQ ID NO: 39388 - DNA, 15 bp, Homo sapiens
cgcaaccgaacaccc

SEQ ID NO: 39389 - DNA, 15 bp, Homo sapiens
acgcaaccgaacacc

SEQ ID NO: 39390 - DNA, 15 bp, Homo sapiens
cacgcaaccgaacac

SEQ ID NO: 39391 - DNA, 15 bp, Homo sapiens
gcacgcaaccgaaca

SEQ ID NO: 39392 - DNA, 15 bp, Homo sapiens
tgcacgcaaccgaac

SEQ ID NO: 39393 - DNA, 15 bp, Homo sapiens
atgcacgcaaccgaa

SEQ ID NO: 39394 - DNA, 15 bp, Homo sapiens
catgcacgcaaccga

SEQ ID NO: 39395 - DNA, 15 bp, Homo sapiens
acatgcacgcaaccg

SEQ ID NO: 39396 - DNA, 15 bp, Homo sapiens
cacatgcacgcaacc

SEQ ID NO: 39397 - DNA, 15 bp, Homo sapiens
gcacatgcacgcaac

SEQ ID NO: 39398 - DNA, 15 bp, Homo sapiens
cgcacatgcacgcaa

SEQ ID NO: 39399 - DNA, 15 bp, Homo sapiens
acgcacatgcacgca

SEQ ID NO: 39400 - DNA, 15 bp, Homo sapiens
aacgcacatgcacgc

SEQ ID NO: 39401 - DNA, 15 bp, Homo sapiens
aaacgcacatgcacg

SEQ ID NO: 39402 - DNA, 15 bp, Homo sapiens
aaaacgcacatgcac

SEQ ID NO: 39403 - DNA, 15 bp, Homo sapiens
aaaaacgcacatgca

SEQ ID NO: 39404 - DNA, 15 bp, Homo sapiens
taaaaacgcacatgc

SEQ ID NO: 39405 - DNA, 15 bp, Homo sapiens
ctaaaaacgcacatg

SEQ ID NO: 39406 - DNA, 15 bp, Homo sapiens
gctaaaaacgcacat

SEQ ID NO: 39407 - DNA, 15 bp, Homo sapiens
tgctaaaaacgcaca

SEQ ID NO: 39408 - DNA, 15 bp, Homo sapiens
ttgctaaaaacgcac

SEQ ID NO: 39409 - DNA, 15 bp, Homo sapiens
gttgctaaaaacgca

SEQ ID NO: 39410 - DNA, 15 bp, Homo sapiens
tgttgctaaaaacgc

SEQ ID NO: 39411 - DNA, 15 bp, Homo sapiens
gtgttgctaaaaacg

SEQ ID NO: 39412 - DNA, 15 bp, Homo sapiens
tgtgttgctaaaaac

SEQ ID NO: 39413 - DNA, 15 bp, Homo sapiens
atgtgttgctaaaaa

SEQ ID NO: 39414 - DNA, 15 bp, Homo sapiens
gatgtgttgctaaaa

SEQ ID NO: 39415 - DNA, 15 bp, Homo sapiens
agatgtgttgctaaa

SEQ ID NO: 39416 - DNA, 15 bp, Homo sapiens
tagatgtgttgctaa

SEQ ID NO: 39417 - DNA, 15 bp, Homo sapiens
gtagatgtgttgcta

SEQ ID NO: 39418 - DNA, 15 bp, Homo sapiens
ggtagatgtgttgct

SEQ ID NO: 39419 - DNA, 15 bp, Homo sapiens
tggtagatgtgttgc

SEQ ID NO: 39420 - DNA, 15 bp, Homo sapiens
ttggtagatgtgttg

SEQ ID NO: 39421 - DNA, 15 bp, Homo sapiens
gttggtagatgtgtt

SEQ ID NO: 39422 - DNA, 15 bp, Homo sapiens
ggttggtagatgtgt

SEQ ID NO: 39423 - DNA, 15 bp, Homo sapiens
gggttggtagatgtg

SEQ ID NO: 39424 - DNA, 15 bp, Homo sapiens
agggttggtagatgt

SEQ ID NO: 39425 - DNA, 15 bp, Homo sapiens
cagggttggtagatg

SEQ ID NO: 39426 - DNA, 15 bp, Homo sapiens
acagggttggtagat

SEQ ID NO: 39427 - DNA, 15 bp, Homo sapiens
cacagggttggtaga

SEQ ID NO: 39428 - DNA, 15 bp, Homo sapiens
gcacagggttggtag

SEQ ID NO: 39429 - DNA, 15 bp, Homo sapiens
tgcacagggttggta

SEQ ID NO: 39430 - DNA, 15 bp, Homo sapiens
atgcacagggttggt

SEQ ID NO: 39431 - DNA, 15 bp, Homo sapiens
catgcacagggttgg

SEQ ID NO: 39432 - DNA, 15 bp, Homo sapiens
tcatgcacagggttg

SEQ ID NO: 39433 - DNA, 15 bp, Homo sapiens
gtcatgcacagggtt

SEQ ID NO: 39434 - DNA, 15 bp, Homo sapiens
agtcatgcacagggt

SEQ ID NO: 39435 - DNA, 15 bp, Homo sapiens
cagtcatgcacaggg

SEQ ID NO: 39436 - DNA, 15 bp, Homo sapiens
tcagtcatgcacagg

SEQ ID NO: 39437 - DNA, 15 bp, Homo sapiens
atcagtcatgcacag

SEQ ID NO: 39438 - DNA, 15 bp, Homo sapiens
catcagtcatgcaca

SEQ ID NO: 39439 - DNA, 15 bp, Homo sapiens
acatcagtcatgcac

SEQ ID NO: 39440 - DNA, 15 bp, Homo sapiens
aacatcagtcatgca

SEQ ID NO: 39441 - DNA, 15 bp, Homo sapiens
caacatcagtcatgc

SEQ ID NO: 39442 - DNA, 15 bp, Homo sapiens
ccaacatcagtcatg

SEQ ID NO: 39443 - DNA, 15 bp, Homo sapiens
cccaacatcagtcat

SEQ ID NO: 39444 - DNA, 15 bp, Homo sapiens
ccccaacatcagtca

SEQ ID NO: 39445 - DNA, 15 bp, Homo sapiens
tccccaacatcagtc

SEQ ID NO: 39446 - DNA, 15 bp, Homo sapiens
ttccccaacatcagt

SEQ ID NO: 39447 - DNA, 15 bp, Homo sapiens
tttccccaacatcag

SEQ ID NO: 39448 - DNA, 15 bp, Homo sapiens
ttttccccaacatca

SEQ ID NO: 39449 - DNA, 15 bp, Homo sapiens
tttttccccaacatc

SEQ ID NO: 39450 - DNA, 15 bp, Homo sapiens
ctttttccccaacat

SEQ ID NO: 39451 - DNA, 15 bp, Homo sapiens
tctttttccccaaca

SEQ ID NO: 39452 - DNA, 15 bp, Homo sapiens
ttctttttccccaac

SEQ ID NO: 39453 - DNA, 15 bp, Homo sapiens
tttctttttccccaa

SEQ ID NO: 39454 - DNA, 15 bp, Homo sapiens
ttttctttttcccca

SEQ ID NO: 39455 - DNA, 15 bp, Homo sapiens
cttttctttttcccc

SEQ ID NO: 39456 - DNA, 15 bp, Homo sapiens
acttttctttttccc

SEQ ID NO: 39457 - DNA, 15 bp, Homo sapiens
tacttttctttttcc

SEQ ID NO: 39458 - DNA, 15 bp, Homo sapiens
ttacttttctttttc

SEQ ID NO: 39459 - DNA, 15 bp, Homo sapiens
tttacttttcttttt

SEQ ID NO: 39460 - DNA, 15 bp, Homo sapiens
ttttacttttctttt

SEQ ID NO: 39461 - DNA, 15 bp, Homo sapiens
tttttacttttcttt

SEQ ID NO: 39462 - DNA, 15 bp, Homo sapiens
ttttttacttttctt

SEQ ID NO: 39463 - DNA, 15 bp, Homo sapiens
gttttttacttttct

SEQ ID NO: 39464 - DNA, 15 bp, Homo sapiens
agttttttacttttc

SEQ ID NO: 39465 - DNA, 15 bp, Homo sapiens
aagttttttactttt

SEQ ID NO: 39466 - DNA, 15 bp, Homo sapiens
gaagttttttacttt

SEQ ID NO: 39467 - DNA, 15 bp, Homo sapiens
ggaagttttttactt

SEQ ID NO: 39468 - DNA, 15 bp, Homo sapiens
gggaagttttttact

SEQ ID NO: 39469 - DNA, 15 bp, Homo sapiens
tgggaagttttttac

SEQ ID NO: 39470 - DNA, 15 bp, Homo sapiens
ttgggaagtttttta

SEQ ID NO: 39471 - DNA, 15 bp, Homo sapiens
gttgggaagtttttt

SEQ ID NO: 39472 - DNA, 15 bp, Homo sapiens
agttgggaagttttt

SEQ ID NO: 39473 - DNA, 15 bp, Homo sapiens
gagttgggaagtttt

SEQ ID NO: 39474 - DNA, 15 bp, Homo sapiens
tgagttgggaagttt

SEQ ID NO: 39475 - DNA, 15 bp, Homo sapiens
gtgagttgggaagtt

SEQ ID NO: 39476 - DNA, 15 bp, Homo sapiens
agtgagttgggaagt

SEQ ID NO: 39477 - DNA, 15 bp, Homo sapiens
aagtgagttgggaag

SEQ ID NO: 39478 - DNA, 15 bp, Homo sapiens
aaagtgagttgggaa

SEQ ID NO: 39479 - DNA, 15 bp, Homo sapiens
caaagtgagttggga

SEQ ID NO: 39480 - DNA, 15 bp, Homo sapiens
acaaagtgagttggg

SEQ ID NO: 39481 - DNA, 15 bp, Homo sapiens
cacaaagtgagttgg

SEQ ID NO: 39482 - DNA, 15 bp, Homo sapiens
acacaaagtgagttg

SEQ ID NO: 39483 - DNA, 15 bp, Homo sapiens
aacacaaagtgagtt

SEQ ID NO: 39484 - DNA, 15 bp, Homo sapiens
taacacaaagtgagt

SEQ ID NO: 39485 - DNA, 15 bp, Homo sapiens
ataacacaaagtgag

SEQ ID NO: 39486 - DNA, 15 bp, Homo sapiens
cataacacaaagtga

SEQ ID NO: 39487 - DNA, 15 bp, Homo sapiens
acataacacaaagtg

SEQ ID NO: 39488 - DNA, 15 bp, Homo sapiens
cacataacacaaagt

SEQ ID NO: 39489 - DNA, 15 bp, Homo sapiens
ccacataacacaaag

SEQ ID NO: 39490 - DNA, 15 bp, Homo sapiens
tccacataacacaaa

SEQ ID NO: 39491 - DNA, 15 bp, Homo sapiens
ctccacataacacaa

SEQ ID NO: 39492 - DNA, 15 bp, Homo sapiens
cctccacataacaca

SEQ ID NO: 39493 - DNA, 15 bp, Homo sapiens
tcctccacataacac

SEQ ID NO: 39494 - DNA, 15 bp, Homo sapiens
ttcctccacataaca

SEQ ID NO: 39495 - DNA, 15 bp, Homo sapiens
tttcctccacataac

SEQ ID NO: 39496 - DNA, 15 bp, Homo sapiens
atttcctccacataa

SEQ ID NO: 39497 - DNA, 15 bp, Homo sapiens
catttcctccacata

SEQ ID NO: 39498 - DNA, 15 bp, Homo sapiens
acatttcctccacat

SEQ ID NO: 39499 - DNA, 15 bp, Homo sapiens
cacatttcctccaca

SEQ ID NO: 39500 - DNA, 15 bp, Homo sapiens
acacatttcctccac

SEQ ID NO: 39501 - DNA, 15 bp, Homo sapiens
tacacatttcctcca

SEQ ID NO: 39502 - DNA, 15 bp, Homo sapiens
atacacatttcctcc

SEQ ID NO: 39503 - DNA, 15 bp, Homo sapiens
aatacacatttcctc

SEQ ID NO: 39504 - DNA, 15 bp, Homo sapiens
taatacacatttcct

SEQ ID NO: 39505 - DNA, 15 bp, Homo sapiens
gtaatacacatttcc

SEQ ID NO: 39506 - DNA, 15 bp, Homo sapiens
ggtaatacacatttc

SEQ ID NO: 39507 - DNA, 15 bp, Homo sapiens
tggtaatacacattt

SEQ ID NO: 39508 - DNA, 15 bp, Homo sapiens
ttggtaatacacatt

SEQ ID NO: 39509 - DNA, 15 bp, Homo sapiens
attggtaatacacat

SEQ ID NO: 39510 - DNA, 15 bp, Homo sapiens
cattggtaatacaca

SEQ ID NO: 39511 - DNA, 15 bp, Homo sapiens
ccattggtaatacac

SEQ ID NO: 39512 - DNA, 15 bp, Homo sapiens
cccattggtaataca

SEQ ID NO: 39513 - DNA, 15 bp, Homo sapiens
ccccattggtaatac

SEQ ID NO: 39514 - DNA, 15 bp, Homo sapiens
accccattggtaata

SEQ ID NO: 39515 - DNA, 15 bp, Homo sapiens
aaccccattggtaat

SEQ ID NO: 39516 - DNA, 15 bp, Homo sapiens
caaccccattggtaa

SEQ ID NO: 39517 - DNA, 15 bp, Homo sapiens
acaaccccattggta

SEQ ID NO: 39518 - DNA, 15 bp, Homo sapiens
aacaaccccattggt

SEQ ID NO: 39519 - DNA, 15 bp, Homo sapiens
taacaaccccattgg

SEQ ID NO: 39520 - DNA, 15 bp, Homo sapiens
ctaacaaccccattg

SEQ ID NO: 39521 - DNA, 15 bp, Homo sapiens
gctaacaaccccatt

SEQ ID NO: 39522 - DNA, 15 bp, Homo sapiens
agctaacaaccccat

SEQ ID NO: 39523 - DNA, 15 bp, Homo sapiens
aagctaacaacccca

SEQ ID NO: 39524 - DNA, 15 bp, Homo sapiens
aaagctaacaacccc

SEQ ID NO: 39525 - DNA, 15 bp, Homo sapiens
aaaagctaacaaccc

SEQ ID NO: 39526 - DNA, 15 bp, Homo sapiens
taaaagctaacaacc

SEQ ID NO: 39527 - DNA, 15 bp, Homo sapiens
ttaaaagctaacaac

SEQ ID NO: 39528 - DNA, 15 bp, Homo sapiens
tttaaaagctaacaa

SEQ ID NO: 39529 - DNA, 15 bp, Homo sapiens
atttaaaagctaaca

SEQ ID NO: 39530 - DNA, 15 bp, Homo sapiens
gatttaaaagctaac

SEQ ID NO: 39531 - DNA, 15 bp, Homo sapiens
tgatttaaaagctaa

SEQ ID NO: 39532 - DNA, 15 bp, Homo sapiens
ttgatttaaaagcta

SEQ ID NO: 39533 - DNA, 15 bp, Homo sapiens
tttgatttaaaagct

SEQ ID NO: 39534 - DNA, 15 bp, Homo sapiens
ttttgatttaaaagc

SEQ ID NO: 39535 - DNA, 15 bp, Homo sapiens
attttgatttaaaag

SEQ ID NO: 39536 - DNA, 15 bp, Homo sapiens
tattttgatttaaaa

SEQ ID NO: 39537 - DNA, 15 bp, Homo sapiens
gtattttgatttaaa

SEQ ID NO: 39538 - DNA, 15 bp, Homo sapiens
agtattttgatttaa

SEQ ID NO: 39539 - DNA, 15 bp, Homo sapiens
cagtattttgattta

SEQ ID NO: 39540 - DNA, 15 bp, Homo sapiens
tcagtattttgattt

SEQ ID NO: 39541 - DNA, 15 bp, Homo sapiens
atcagtattttgatt

SEQ ID NO: 39542 - DNA, 15 bp, Homo sapiens
aatcagtattttgat

SEQ ID NO: 39543 - DNA, 15 bp, Homo sapiens
taatcagtattttga

SEQ ID NO: 39544 - DNA, 15 bp, Homo sapiens
gtaatcagtattttg

SEQ ID NO: 39545 - DNA, 15 bp, Homo sapiens
tgtaatcagtatttt

SEQ ID NO: 39546 - DNA, 15 bp, Homo sapiens
ctgtaatcagtattt

SEQ ID NO: 39547 - DNA, 15 bp, Homo sapiens
tctgtaatcagtatt

SEQ ID NO: 39548 - DNA, 15 bp, Homo sapiens
atctgtaatcagtat

SEQ ID NO: 39549 - DNA, 15 bp, Homo sapiens
catctgtaatcagta

SEQ ID NO: 39550 - DNA, 15 bp, Homo sapiens
acatctgtaatcagt

SEQ ID NO: 39551 - DNA, 15 bp, Homo sapiens
tacatctgtaatcag

SEQ ID NO: 39552 - DNA, 15 bp, Homo sapiens
gtacatctgtaatca

SEQ ID NO: 39553 - DNA, 15 bp, Homo sapiens
tgtacatctgtaatc

SEQ ID NO: 39554 - DNA, 15 bp, Homo sapiens
ttgtacatctgtaat

SEQ ID NO: 39555 - DNA, 15 bp, Homo sapiens
attgtacatctgtaa

SEQ ID NO: 39556 - DNA, 15 bp, Homo sapiens
aattgtacatctgta

SEQ ID NO: 39557 - DNA, 15 bp, Homo sapiens
aaattgtacatctgt

SEQ ID NO: 39558 - DNA, 15 bp, Homo sapiens
taaattgtacatctg

SEQ ID NO: 39559 - DNA, 15 bp, Homo sapiens
ctaaattgtacatct

SEQ ID NO: 39560 - DNA, 15 bp, Homo sapiens
gctaaattgtacatc

SEQ ID NO: 39561 - DNA, 15 bp, Homo sapiens
agctaaattgtacat

SEQ ID NO: 39562 - DNA, 15 bp, Homo sapiens
aagctaaattgtaca

SEQ ID NO: 39563 - DNA, 15 bp, Homo sapiens
taagctaaattgtac

SEQ ID NO: 39564 - DNA, 15 bp, Homo sapiens
ttaagctaaattgta

SEQ ID NO: 39565 - DNA, 15 bp, Homo sapiens
attaagctaaattgt

SEQ ID NO: 39566 - DNA, 15 bp, Homo sapiens
gattaagctaaattg

SEQ ID NO: 39567 - DNA, 15 bp, Homo sapiens
tgattaagctaaatt

SEQ ID NO: 39568 - DNA, 15 bp, Homo sapiens
ctgattaagctaaat

SEQ ID NO: 39569 - DNA, 15 bp, Homo sapiens
tctgattaagctaaa

SEQ ID NO: 39570 - DNA, 15 bp, Homo sapiens
ttctgattaagctaa

SEQ ID NO: 39571 - DNA, 15 bp, Homo sapiens
tttctgattaagcta

SEQ ID NO: 39572 - DNA, 15 bp, Homo sapiens
ctttctgattaagct

SEQ ID NO: 39573 - DNA, 15 bp, Homo sapiens
gctttctgattaagc

SEQ ID NO: 39574 - DNA, 15 bp, Homo sapiens
ggctttctgattaag

SEQ ID NO: 39575 - DNA, 15 bp, Homo sapiens
aggctttctgattaa

SEQ ID NO: 39576 - DNA, 15 bp, Homo sapiens
gaggctttctgatta

SEQ ID NO: 39577 - DNA, 15 bp, Homo sapiens
agaggctttctgatt

SEQ ID NO: 39578 - DNA, 15 bp, Homo sapiens
gagaggctttctgat

SEQ ID NO: 39579 - DNA, 15 bp, Homo sapiens
ggagaggctttctga

SEQ ID NO: 39580 - DNA, 15 bp, Homo sapiens
tggagaggctttctg

SEQ ID NO: 39581 - DNA, 15 bp, Homo sapiens
ctggagaggctttct

SEQ ID NO: 39582 - DNA, 15 bp, Homo sapiens
tctggagaggctttc

SEQ ID NO: 39583 - DNA, 15 bp, Homo sapiens
ctctggagaggcttt

SEQ ID NO: 39584 - DNA, 15 bp, Homo sapiens
tctctggagaggctt

SEQ ID NO: 39585 - DNA, 15 bp, Homo sapiens
ttctctggagaggct

SEQ ID NO: 39586 - DNA, 15 bp, Homo sapiens
cttctctggagaggc

SEQ ID NO: 39587 - DNA, 15 bp, Homo sapiens
acttctctggagagg

SEQ ID NO: 39588 - DNA, 15 bp, Homo sapiens
aacttctctggagag

SEQ ID NO: 39589 - DNA, 15 bp, Homo sapiens
aaacttctctggaga

SEQ ID NO: 39590 - DNA, 15 bp, Homo sapiens
caaacttctctggag

SEQ ID NO: 39591 - DNA, 15 bp, Homo sapiens
ccaaacttctctgga

SEQ ID NO: 39592 - DNA, 15 bp, Homo sapiens
accaaacttctctgg

SEQ ID NO: 39593 - DNA, 15 bp, Homo sapiens
aaccaaacttctctg

SEQ ID NO: 39594 - DNA, 15 bp, Homo sapiens
aaaccaaacttctct

SEQ ID NO: 39595 - DNA, 15 bp, Homo sapiens
gaaaccaaacttctc

SEQ ID NO: 39596 - DNA, 15 bp, Homo sapiens
agaaaccaaacttct

SEQ ID NO: 39597 - DNA, 15 bp, Homo sapiens
aagaaaccaaacttc

SEQ ID NO: 39598 - DNA, 15 bp, Homo sapiens
aaagaaaccaaactt

SEQ ID NO: 39599 - DNA, 15 bp, Homo sapiens
caaagaaaccaaact

SEQ ID NO: 39600 - DNA, 15 bp, Homo sapiens
gcaaagaaaccaaac

SEQ ID NO: 39601 - DNA, 15 bp, Homo sapiens
agcaaagaaaccaaa

SEQ ID NO: 39602 - DNA, 15 bp, Homo sapiens
cagcaaagaaaccaa

SEQ ID NO: 39603 - DNA, 15 bp, Homo sapiens
gcagcaaagaaacca

SEQ ID NO: 39604 - DNA, 15 bp, Homo sapiens
tgcagcaaagaaacc

SEQ ID NO: 39605 - DNA, 15 bp, Homo sapiens
ttgcagcaaagaaac

SEQ ID NO: 39606 - DNA, 15 bp, Homo sapiens
cttgcagcaaagaaa

SEQ ID NO: 39607 - DNA, 15 bp, Homo sapiens
tcttgcagcaaagaa

SEQ ID NO: 39608 - DNA, 15 bp, Homo sapiens
ctcttgcagcaaaga

SEQ ID NO: 39609 - DNA, 15 bp, Homo sapiens
cctcttgcagcaaag

SEQ ID NO: 39610 - DNA, 15 bp, Homo sapiens
tcctcttgcagcaaa

SEQ ID NO: 39611 - DNA, 15 bp, Homo sapiens
ttcctcttgcagcaa

SEQ ID NO: 39612 - DNA, 15 bp, Homo sapiens
attcctcttgcagca

SEQ ID NO: 39613 - DNA, 15 bp, Homo sapiens
cattcctcttgcagc

SEQ ID NO: 39614 - DNA, 15 bp, Homo sapiens
tcattcctcttgcag

SEQ ID NO: 39615 - DNA, 15 bp, Homo sapiens
ctcattcctcttgca

SEQ ID NO: 39616 - DNA, 15 bp, Homo sapiens
cctcattcctcttgc

SEQ ID NO: 39617 - DNA, 15 bp, Homo sapiens
gcctcattcctcttg

SEQ ID NO: 39618 - DNA, 15 bp, Homo sapiens
agcctcattcctctt

SEQ ID NO: 39619 - DNA, 15 bp, Homo sapiens
gagcctcattcctct

SEQ ID NO: 39620 - DNA, 15 bp, Homo sapiens
agagcctcattcctc

SEQ ID NO: 39621 - DNA, 15 bp, Homo sapiens
cagagcctcattcct

SEQ ID NO: 39622 - DNA, 15 bp, Homo sapiens
acagagcctcattcc

SEQ ID NO: 39623 - DNA, 15 bp, Homo sapiens
tacagagcctcattc

SEQ ID NO: 39624 - DNA, 15 bp, Homo sapiens
ttacagagcctcatt

SEQ ID NO: 39625 - DNA, 15 bp, Homo sapiens
gttacagagcctcat

SEQ ID NO: 39626 - DNA, 15 bp, Homo sapiens
ggttacagagcctca

SEQ ID NO: 39627 - DNA, 15 bp, Homo sapiens
aggttacagagcctc

SEQ ID NO: 39628 - DNA, 15 bp, Homo sapiens
aaggttacagagcct

SEQ ID NO: 39629 - DNA, 15 bp, Homo sapiens
taaggttacagagcc

SEQ ID NO: 39630 - DNA, 15 bp, Homo sapiens
ataaggttacagagc

SEQ ID NO: 39631 - DNA, 15 bp, Homo sapiens
gataaggttacagag

SEQ ID NO: 39632 - DNA, 15 bp, Homo sapiens
agataaggttacaga

SEQ ID NO: 39633 - DNA, 15 bp, Homo sapiens
tagataaggttacag

SEQ ID NO: 39634 - DNA, 15 bp, Homo sapiens
ttagataaggttaca

SEQ ID NO: 39635 - DNA, 15 bp, Homo sapiens
cttagataaggttac

SEQ ID NO: 39636 - DNA, 15 bp, Homo sapiens
tcttagataaggtta

SEQ ID NO: 39637 - DNA, 15 bp, Homo sapiens
ttcttagataaggtt

SEQ ID NO: 39638 - DNA, 15 bp, Homo sapiens
gttcttagataaggt

SEQ ID NO: 39639 - DNA, 15 bp, Homo sapiens
agttcttagataagg

SEQ ID NO: 39640 - DNA, 15 bp, Homo sapiens
aagttcttagataag

SEQ ID NO: 39641 - DNA, 15 bp, Homo sapiens
caagttcttagataa

SEQ ID NO: 39642 - DNA, 15 bp, Homo sapiens
ccaagttcttagata

SEQ ID NO: 39643 - DNA, 15 bp, Homo sapiens
tccaagttcttagat

SEQ ID NO: 39644 - DNA, 15 bp, Homo sapiens
ttccaagttcttaga

SEQ ID NO: 39645 - DNA, 15 bp, Homo sapiens
cttccaagttcttag

SEQ ID NO: 39646 - DNA, 15 bp, Homo sapiens
gcttccaagttctta

SEQ ID NO: 39647 - DNA, 15 bp, Homo sapiens
ggcttccaagttctt

SEQ ID NO: 39648 - DNA, 15 bp, Homo sapiens
cggcttccaagttct

SEQ ID NO: 39649 - DNA, 15 bp, Homo sapiens
acggcttccaagttc

SEQ ID NO: 39650 - DNA, 15 bp, Homo sapiens
gacggcttccaagtt

SEQ ID NO: 39651 - DNA, 15 bp, Homo sapiens
tgacggcttccaagt

SEQ ID NO: 39652 - DNA, 15 bp, Homo sapiens
ctgacggcttccaag

SEQ ID NO: 39653 - DNA, 15 bp, Homo sapiens
gctgacggcttccaa

SEQ ID NO: 39654 - DNA, 15 bp, Homo sapiens
ggctgacggcttcca

SEQ ID NO: 39655 - DNA, 15 bp, Homo sapiens
tggctgacggcttcc

SEQ ID NO: 39656 - DNA, 15 bp, Homo sapiens
ttggctgacggcttc

SEQ ID NO: 39657 - DNA, 15 bp, Homo sapiens
cttggctgacggctt

SEQ ID NO: 39658 - DNA, 15 bp, Homo sapiens
acttggctgacggct

SEQ ID NO: 39659 - DNA, 15 bp, Homo sapiens
gacttggctgacggc

SEQ ID NO: 39660 - DNA, 15 bp, Homo sapiens
cgacttggctgacgg

SEQ ID NO: 39661 - DNA, 15 bp, Homo sapiens
gcgacttggctgacg

SEQ ID NO: 39662 - DNA, 15 bp, Homo sapiens
ggcgacttggctgac

SEQ ID NO: 39663 - DNA, 15 bp, Homo sapiens
tggcgacttggctga

SEQ ID NO: 39664 - DNA, 15 bp, Homo sapiens
gtggcgacttggctg

SEQ ID NO: 39665 - DNA, 15 bp, Homo sapiens
tgtggcgacttggct

SEQ ID NO: 39666 - DNA, 15 bp, Homo sapiens
atgtggcgacttggc

SEQ ID NO: 39667 - DNA, 15 bp, Homo sapiens
aatgtggcgacttgg

SEQ ID NO: 39668 - DNA, 15 bp, Homo sapiens
aaatgtggcgacttg

SEQ ID NO: 39669 - DNA, 15 bp, Homo sapiens
gaaatgtggcgactt

SEQ ID NO: 39670 - DNA, 15 bp, Homo sapiens
agaaatgtggcgact

SEQ ID NO: 39671 - DNA, 15 bp, Homo sapiens
gagaaatgtggcgac

SEQ ID NO: 39672 - DNA, 15 bp, Homo sapiens
agagaaatgtggcga

SEQ ID NO: 39673 - DNA, 15 bp, Homo sapiens
cagagaaatgtggcg

SEQ ID NO: 39674 - DNA, 15 bp, Homo sapiens
gcagagaaatgtggc

SEQ ID NO: 39675 - DNA, 15 bp, Homo sapiens
tgcagagaaatgtgg

SEQ ID NO: 39676 - DNA, 15 bp, Homo sapiens
ttgcagagaaatgtg

SEQ ID NO: 39677 - DNA, 15 bp, Homo sapiens
tttgcagagaaatgt

SEQ ID NO: 39678 - DNA, 15 bp, Homo sapiens
ttttgcagagaaatg

SEQ ID NO: 39679 - DNA, 15 bp, Homo sapiens
attttgcagagaaat

SEQ ID NO: 39680 - DNA, 15 bp, Homo sapiens
cattttgcagagaaa

SEQ ID NO: 39681 - DNA, 15 bp, Homo sapiens
acattttgcagagaa

SEQ ID NO: 39682 - DNA, 15 bp, Homo sapiens
gacattttgcagaga

SEQ ID NO: 39683 - DNA, 15 bp, Homo sapiens
tgacattttgcagag

SEQ ID NO: 39684 - DNA, 15 bp, Homo sapiens
atgacattttgcaga

SEQ ID NO: 39685 - DNA, 15 bp, Homo sapiens
tatgacattttgcag

SEQ ID NO: 39686 - DNA, 15 bp, Homo sapiens
ctatgacattttgca

SEQ ID NO: 39687 - DNA, 15 bp, Homo sapiens
gctatgacattttgc

SEQ ID NO: 39688 - DNA, 15 bp, Homo sapiens
agctatgacattttg

SEQ ID NO: 39689 - DNA, 15 bp, Homo sapiens
aagctatgacatttt

SEQ ID NO: 39690 - DNA, 15 bp, Homo sapiens
taagctatgacattt

SEQ ID NO: 39691 - DNA, 15 bp, Homo sapiens
ataagctatgacatt

SEQ ID NO: 39692 - DNA, 15 bp, Homo sapiens
tataagctatgacat

SEQ ID NO: 39693 - DNA, 15 bp, Homo sapiens
atataagctatgaca

SEQ ID NO: 39694 - DNA, 15 bp, Homo sapiens
tatataagctatgac

SEQ ID NO: 39695 - DNA, 15 bp, Homo sapiens
ttatataagctatga

SEQ ID NO: 39696 - DNA, 15 bp, Homo sapiens
tttatataagctatg

SEQ ID NO: 39697 - DNA, 15 bp, Homo sapiens
atttatataagctat

SEQ ID NO: 39698 - DNA, 15 bp, Homo sapiens
catttatataagcta

SEQ ID NO: 39699 - DNA, 15 bp, Homo sapiens
acatttatataagct

SEQ ID NO: 39700 - DNA, 15 bp, Homo sapiens
tacatttatataagc

SEQ ID NO: 39701 - DNA, 15 bp, Homo sapiens
gtacatttatataag

SEQ ID NO: 39702 - DNA, 15 bp, Homo sapiens
tgtacatttatataa

SEQ ID NO: 39703 - DNA, 15 bp, Homo sapiens
ctgtacatttatata

SEQ ID NO: 39704 - DNA, 15 bp, Homo sapiens
actgtacatttatat

SEQ ID NO: 39705 - DNA, 15 bp, Homo sapiens
tactgtacatttata

SEQ ID NO: 39706 - DNA, 15 bp, Homo sapiens
atactgtacatttat

SEQ ID NO: 39707 - DNA, 15 bp, Homo sapiens
aatactgtacattta

SEQ ID NO: 39708 - DNA, 15 bp, Homo sapiens
gaatactgtacattt

SEQ ID NO: 39709 - DNA, 15 bp, Homo sapiens
tgaatactgtacatt

SEQ ID NO: 39710 - DNA, 15 bp, Homo sapiens
ttgaatactgtacat

SEQ ID NO: 39711 - DNA, 15 bp, Homo sapiens
attgaatactgtaca

SEQ ID NO: 39712 - DNA, 15 bp, Homo sapiens
aattgaatactgtac

SEQ ID NO: 39713 - DNA, 15 bp, Homo sapiens
caattgaatactgta

SEQ ID NO: 39714 - DNA, 15 bp, Homo sapiens
acaattgaatactgt

SEQ ID NO: 39715 - DNA, 15 bp, Homo sapiens
tacaattgaatactg

SEQ ID NO: 39716 - DNA, 15 bp, Homo sapiens
ttacaattgaatact

SEQ ID NO: 39717 - DNA, 15 bp, Homo sapiens
attacaattgaatac

SEQ ID NO: 39718 - DNA, 15 bp, Homo sapiens
cattacaattgaata

SEQ ID NO: 39719 - DNA, 15 bp, Homo sapiens
gcattacaattgaat

SEQ ID NO: 39720 - DNA, 15 bp, Homo sapiens
tgcattacaattgaa

SEQ ID NO: 39721 - DNA, 15 bp, Homo sapiens
atgcattacaattga

SEQ ID NO: 39722 - DNA, 15 bp, Homo sapiens
catgcattacaattg

SEQ ID NO: 39723 - DNA, 15 bp, Homo sapiens
gcatgcattacaatt

SEQ ID NO: 39724 - DNA, 15 bp, Homo sapiens
ggcatgcattacaat

SEQ ID NO: 39725 - DNA, 15 bp, Homo sapiens
aggcatgcattacaa

SEQ ID NO: 39726 - DNA, 15 bp, Homo sapiens
aaggcatgcattaca

SEQ ID NO: 39727 - DNA, 15 bp, Homo sapiens
gaaggcatgcattac

SEQ ID NO: 39728 - DNA, 15 bp, Homo sapiens
cgaaggcatgcatta

SEQ ID NO: 39729 - DNA, 15 bp, Homo sapiens
ccgaaggcatgcatt

SEQ ID NO: 39730 - DNA, 15 bp, Homo sapiens
accgaaggcatgcat

SEQ ID NO: 39731 - DNA, 15 bp, Homo sapiens
aaccgaaggcatgca

SEQ ID NO: 39732 - DNA, 15 bp, Homo sapiens
caaccgaaggcatgc

SEQ ID NO: 39733 - DNA, 15 bp, Homo sapiens
acaaccgaaggcatg

SEQ ID NO: 39734 - DNA, 15 bp, Homo sapiens
tacaaccgaaggcat

SEQ ID NO: 39735 - DNA, 15 bp, Homo sapiens
ttacaaccgaaggca

SEQ ID NO: 39736 - DNA, 15 bp, Homo sapiens
cttacaaccgaaggc

SEQ ID NO: 39737 - DNA, 15 bp, Homo sapiens
acttacaaccgaagg

SEQ ID NO: 39738 - DNA, 15 bp, Homo sapiens
tacttacaaccgaag

SEQ ID NO: 39739 - DNA, 15 bp, Homo sapiens
ctacttacaaccgaa

SEQ ID NO: 39740 - DNA, 15 bp, Homo sapiens
gctacttacaaccga

SEQ ID NO: 39741 - DNA, 15 bp, Homo sapiens
ggctacttacaaccg

SEQ ID NO: 39742 - DNA, 15 bp, Homo sapiens
tggctacttacaacc

SEQ ID NO: 39743 - DNA, 15 bp, Homo sapiens
ctggctacttacaac

SEQ ID NO: 39744 - DNA, 15 bp, Homo sapiens
tctggctacttacaa

SEQ ID NO: 39745 - DNA, 15 bp, Homo sapiens
atctggctacttaca

SEQ ID NO: 39746 - DNA, 15 bp, Homo sapiens
gatctggctacttac

SEQ ID NO: 39747 - DNA, 15 bp, Homo sapiens
ggatctggctactta

SEQ ID NO: 39748 - DNA, 15 bp, Homo sapiens
gggatctggctactt

SEQ ID NO: 39749 - DNA, 15 bp, Homo sapiens
agggatctggctact

SEQ ID NO: 39750 - DNA, 15 bp, Homo sapiens
gagggatctggctac

SEQ ID NO: 39751 - DNA, 15 bp, Homo sapiens
agagggatctggcta

SEQ ID NO: 39752 - DNA, 15 bp, Homo sapiens
gagagggatctggct

SEQ ID NO: 39753 - DNA, 15 bp, Homo sapiens
ggagagggatctggc

SEQ ID NO: 39754 - DNA, 15 bp, Homo sapiens
tggagagggatctgg

SEQ ID NO: 39755 - DNA, 15 bp, Homo sapiens
ctggagagggatctg

SEQ ID NO: 39756 - DNA, 15 bp, Homo sapiens
actggagagggatct

SEQ ID NO: 39757 - DNA, 15 bp, Homo sapiens
cactggagagggatc

SEQ ID NO: 39758 - DNA, 15 bp, Homo sapiens
tcactggagagggat

SEQ ID NO: 39759 - DNA, 15 bp, Homo sapiens
gtcactggagaggga

SEQ ID NO: 39760 - DNA, 15 bp, Homo sapiens
tgtcactggagaggg

SEQ ID NO: 39761 - DNA, 15 bp, Homo sapiens
atgtcactggagagg

SEQ ID NO: 39762 - DNA, 15 bp, Homo sapiens
aatgtcactggagag

SEQ ID NO: 39763 - DNA, 15 bp, Homo sapiens
caatgtcactggaga

SEQ ID NO: 39764 - DNA, 15 bp, Homo sapiens
ccaatgtcactggag

SEQ ID NO: 39765 - DNA, 15 bp, Homo sapiens
tccaatgtcactgga

SEQ ID NO: 39766 - DNA, 15 bp, Homo sapiens
ttccaatgtcactgg

SEQ ID NO: 39767 - DNA, 15 bp, Homo sapiens
gttccaatgtcactg

SEQ ID NO: 39768 - DNA, 15 bp, Homo sapiens
tgttccaatgtcact

SEQ ID NO: 39769 - DNA, 15 bp, Homo sapiens
atgttccaatgtcac

SEQ ID NO: 39770 - DNA, 15 bp, Homo sapiens
catgttccaatgtca

SEQ ID NO: 39771 - DNA, 15 bp, Homo sapiens
gcatgttccaatgtc

SEQ ID NO: 39772 - DNA, 15 bp, Homo sapiens
agcatgttccaatgt

SEQ ID NO: 39773 - DNA, 15 bp, Homo sapiens
tagcatgttccaatg

SEQ ID NO: 39774 - DNA, 15 bp, Homo sapiens
gtagcatgttccaat

SEQ ID NO: 39775 - DNA, 15 bp, Homo sapiens
agtagcatgttccaa

SEQ ID NO: 39776 - DNA, 15 bp, Homo sapiens
aagtagcatgttcca

SEQ ID NO: 39777 - DNA, 15 bp, Homo sapiens
aaagtagcatgttcc

SEQ ID NO: 39778 - DNA, 15 bp, Homo sapiens
aaaagtagcatgttc

SEQ ID NO: 39779 - DNA, 15 bp, Homo sapiens
aaaaagtagcatgtt

SEQ ID NO: 39780 - DNA, 15 bp, Homo sapiens
taaaaagtagcatgt

SEQ ID NO: 39781 - DNA, 15 bp, Homo sapiens
ttaaaaagtagcatg

SEQ ID NO: 39782 - DNA, 15 bp, Homo sapiens
attaaaaagtagcat

SEQ ID NO: 39783 - DNA, 15 bp, Homo sapiens
aattaaaaagtagca

SEQ ID NO: 39784 - DNA, 15 bp, Homo sapiens
caattaaaaagtagc

SEQ ID NO: 39785 - DNA, 15 bp, Homo sapiens
ccaattaaaaagtag

SEQ ID NO: 39786 - DNA, 15 bp, Homo sapiens
gccaattaaaaagta

SEQ ID NO: 39787 - DNA, 15 bp, Homo sapiens
ggccaattaaaaagt

SEQ ID NO: 39788 - DNA, 15 bp, Homo sapiens
gggccaattaaaaag

SEQ ID NO: 39789 - DNA, 15 bp, Homo sapiens
agggccaattaaaaa

SEQ ID NO: 39790 - DNA, 15 bp, Homo sapiens
cagggccaattaaaa

SEQ ID NO: 39791 - DNA, 15 bp, Homo sapiens
acagggccaattaaa

SEQ ID NO: 39792 - DNA, 15 bp, Homo sapiens
tacagggccaattaa

SEQ ID NO: 39793 - DNA, 15 bp, Homo sapiens
gtacagggccaatta

SEQ ID NO: 39794 - DNA, 15 bp, Homo sapiens
tgtacagggccaatt

SEQ ID NO: 39795 - DNA, 15 bp, Homo sapiens
ctgtacagggccaat

SEQ ID NO: 39796 - DNA, 15 bp, Homo sapiens
actgtacagggccaa

SEQ ID NO: 39797 - DNA, 15 bp, Homo sapiens
aactgtacagggcca

SEQ ID NO: 39798 - DNA, 15 bp, Homo sapiens
aaactgtacagggcc

SEQ ID NO: 39799 - DNA, 15 bp, Homo sapiens
caaactgtacagggc

SEQ ID NO: 39800 - DNA, 15 bp, Homo sapiens
gcaaactgtacaggg

SEQ ID NO: 39801 - DNA, 15 bp, Homo sapiens
agcaaactgtacagg

SEQ ID NO: 39802 - DNA, 15 bp, Homo sapiens
aagcaaactgtacag

SEQ ID NO: 39803 - DNA, 15 bp, Homo sapiens
taagcaaactgtaca

SEQ ID NO: 39804 - DNA, 15 bp, Homo sapiens
ataagcaaactgtac

SEQ ID NO: 39805 - DNA, 15 bp, Homo sapiens
aataagcaaactgta

SEQ ID NO: 39806 - DNA, 15 bp, Homo sapiens
aaataagcaaactgt

SEQ ID NO: 39807 - DNA, 15 bp, Homo sapiens
taaataagcaaactg

SEQ ID NO: 39808 - DNA, 15 bp, Homo sapiens
ataaataagcaaact

SEQ ID NO: 39809 - DNA, 15 bp, Homo sapiens
tataaataagcaaac

SEQ ID NO: 39810 - DNA, 15 bp, Homo sapiens
ttataaataagcaaa

SEQ ID NO: 39811 - DNA, 15 bp, Homo sapiens
tttataaataagcaa

SEQ ID NO: 39812 - DNA, 15 bp, Homo sapiens
atttataaataagca

SEQ ID NO: 39813 - DNA, 15 bp, Homo sapiens
aatttataaataagc

SEQ ID NO: 39814 - DNA, 15 bp, Homo sapiens
gaatttataaataag

SEQ ID NO: 39815 - DNA, 15 bp, Homo sapiens
tgaatttataaataa

SEQ ID NO: 39816 - DNA, 15 bp, Homo sapiens
atgaatttataaata

SEQ ID NO: 39817 - DNA, 15 bp, Homo sapiens
aatgaatttataaat

SEQ ID NO: 39818 - DNA, 15 bp, Homo sapiens
taatgaatttataaa

SEQ ID NO: 39819 - DNA, 15 bp, Homo sapiens
ttaatgaatttataa

SEQ ID NO: 39820 - DNA, 15 bp, Homo sapiens
tttaatgaatttata

SEQ ID NO: 39821 - DNA, 15 bp, Homo sapiens
ttttaatgaatttat

SEQ ID NO: 39822 - DNA, 15 bp, Homo sapiens
tttttaatgaattta

SEQ ID NO: 39823 - DNA, 15 bp, Homo sapiens
gtttttaatgaattt

SEQ ID NO: 39824 - DNA, 15 bp, Homo sapiens
tgtttttaatgaatt

SEQ ID NO: 39825 - DNA, 15 bp, Homo sapiens
gtgtttttaatgaat

SEQ ID NO: 39826 - DNA, 15 bp, Homo sapiens
agtgtttttaatgaa

SEQ ID NO: 39827 - DNA, 15 bp, Homo sapiens
tagtgtttttaatga

SEQ ID NO: 39828 - DNA, 15 bp, Homo sapiens
gtagtgtttttaatg

SEQ ID NO: 39829 - DNA, 15 bp, Homo sapiens
tgtagtgtttttaat

SEQ ID NO: 39830 - DNA, 15 bp, Homo sapiens
ctgtagtgtttttaa

SEQ ID NO: 39831 - DNA, 15 bp, Homo sapiens
cctgtagtgttttta

SEQ ID NO: 39832 - DNA, 15 bp, Homo sapiens
acctgtagtgttttt

SEQ ID NO: 39833 - DNA, 15 bp, Homo sapiens
cacctgtagtgtttt

SEQ ID NO: 39834 - DNA, 15 bp, Homo sapiens
acacctgtagtgttt

SEQ ID NO: 39835 - DNA, 15 bp, Homo sapiens
aacacctgtagtgtt

SEQ ID NO: 39836 - DNA, 15 bp, Homo sapiens
caacacctgtagtgt

SEQ ID NO: 39837 - DNA, 15 bp, Homo sapiens
tcaacacctgtagtg

SEQ ID NO: 39838 - DNA, 15 bp, Homo sapiens
ttcaacacctgtagt

SEQ ID NO: 39839 - DNA, 15 bp, Homo sapiens
attcaacacctgtag

SEQ ID NO: 39840 - DNA, 15 bp, Homo sapiens
cattcaacacctgta

SEQ ID NO: 39841 - DNA, 15 bp, Homo sapiens
ccattcaacacctgt

SEQ ID NO: 39842 - DNA, 15 bp, Homo sapiens
accattcaacacctg

SEQ ID NO: 39843 - DNA, 15 bp, Homo sapiens
aaccattcaacacct

SEQ ID NO: 39844 - DNA, 15 bp, Homo sapiens
taaccattcaacacc

SEQ ID NO: 39845 - DNA, 15 bp, Homo sapiens
ttaaccattcaacac

SEQ ID NO: 39846 - DNA, 15 bp, Homo sapiens
tttaaccattcaaca

SEQ ID NO: 39847 - DNA, 15 bp, Homo sapiens
ttttaaccattcaac

SEQ ID NO: 39848 - DNA, 15 bp, Homo sapiens
attttaaccattcaa

SEQ ID NO: 39849 - DNA, 15 bp, Homo sapiens
cattttaaccattca

SEQ ID NO: 39850 - DNA, 15 bp, Homo sapiens
acattttaaccattc

SEQ ID NO: 39851 - DNA, 15 bp, Homo sapiens
tacattttaaccatt

SEQ ID NO: 39852 - DNA, 15 bp, Homo sapiens
ctacattttaaccat

SEQ ID NO: 39853 - DNA, 15 bp, Homo sapiens
cctacattttaacca

SEQ ID NO: 39854 - DNA, 15 bp, Homo sapiens
gcctacattttaacc

SEQ ID NO: 39855 - DNA, 15 bp, Homo sapiens
ggcctacattttaac

SEQ ID NO: 39856 - DNA, 15 bp, Homo sapiens
aggcctacattttaa

SEQ ID NO: 39857 - DNA, 15 bp, Homo sapiens
gaggcctacatttta

SEQ ID NO: 39858 - DNA, 15 bp, Homo sapiens
ggaggcctacatttt

SEQ ID NO: 39859 - DNA, 15 bp, Homo sapiens
tggaggcctacattt

SEQ ID NO: 39860 - DNA, 15 bp, Homo sapiens
ctggaggcctacatt

SEQ ID NO: 39861 - DNA, 15 bp, Homo sapiens
actggaggcctacat

SEQ ID NO: 39862 - DNA, 15 bp, Homo sapiens
aactggaggcctaca

SEQ ID NO: 39863 - DNA, 15 bp, Homo sapiens
gaactggaggcctac

SEQ ID NO: 39864 - DNA, 15 bp, Homo sapiens
tgaactggaggccta

SEQ ID NO: 39865 - DNA, 15 bp, Homo sapiens
atgaactggaggcct

SEQ ID NO: 39866 - DNA, 15 bp, Homo sapiens
aatgaactggaggcc

SEQ ID NO: 39867 - DNA, 15 bp, Homo sapiens
aaatgaactggaggc

SEQ ID NO: 39868 - DNA, 15 bp, Homo sapiens
aaaatgaactggagg

SEQ ID NO: 39869 - DNA, 15 bp, Homo sapiens
gaaaatgaactggag

SEQ ID NO: 39870 - DNA, 15 bp, Homo sapiens
tgaaaatgaactgga

SEQ ID NO: 39871 - DNA, 15 bp, Homo sapiens
ctgaaaatgaactgg

SEQ ID NO: 39872 - DNA, 15 bp, Homo sapiens
actgaaaatgaactg

SEQ ID NO: 39873 - DNA, 15 bp, Homo sapiens
aactgaaaatgaact

SEQ ID NO: 39874 - DNA, 15 bp, Homo sapiens
taactgaaaatgaac

SEQ ID NO: 39875 - DNA, 15 bp, Homo sapiens
ataactgaaaatgaa

SEQ ID NO: 39876 - DNA, 15 bp, Homo sapiens
aataactgaaaatga

SEQ ID NO: 39877 - DNA, 15 bp, Homo sapiens
aaataactgaaaatg

SEQ ID NO: 39878 - DNA, 15 bp, Homo sapiens
aaaataactgaaaat

SEQ ID NO: 39879 - DNA, 15 bp, Homo sapiens
gaaaataactgaaaa

SEQ ID NO: 39880 - DNA, 15 bp, Homo sapiens
agaaaataactgaaa

SEQ ID NO: 39881 - DNA, 15 bp, Homo sapiens
cagaaaataactgaa

SEQ ID NO: 39882 - DNA, 15 bp, Homo sapiens
tcagaaaataactga

SEQ ID NO: 39883 - DNA, 15 bp, Homo sapiens
ctcagaaaataactg

SEQ ID NO: 39884 - DNA, 15 bp, Homo sapiens
actcagaaaataact

SEQ ID NO: 39885 - DNA, 15 bp, Homo sapiens
cactcagaaaataac

SEQ ID NO: 39886 - DNA, 15 bp, Homo sapiens
acactcagaaaataa

SEQ ID NO: 39887 - DNA, 15 bp, Homo sapiens
cacactcagaaaata

SEQ ID NO: 39888 - DNA, 15 bp, Homo sapiens
gcacactcagaaaat

SEQ ID NO: 39889 - DNA, 15 bp, Homo sapiens
tgcacactcagaaaa

SEQ ID NO: 39890 - DNA, 15 bp, Homo sapiens
ctgcacactcagaaa

SEQ ID NO: 39891 - DNA, 15 bp, Homo sapiens
tctgcacactcagaa

SEQ ID NO: 39892 - DNA, 15 bp, Homo sapiens
gtctgcacactcaga

SEQ ID NO: 39893 - DNA, 15 bp, Homo sapiens
tgtctgcacactcag

SEQ ID NO: 39894 - DNA, 15 bp, Homo sapiens
ctgtctgcacactca

SEQ ID NO: 39895 - DNA, 15 bp, Homo sapiens
gctgtctgcacactc

SEQ ID NO: 39896 - DNA, 15 bp, Homo sapiens
agctgtctgcacact

SEQ ID NO: 39897 - DNA, 15 bp, Homo sapiens
tagctgtctgcacac

SEQ ID NO: 39898 - DNA, 15 bp, Homo sapiens
atagctgtctgcaca

SEQ ID NO: 39899 - DNA, 15 bp, Homo sapiens
aatagctgtctgcac

SEQ ID NO: 39900 - DNA, 15 bp, Homo sapiens
aaatagctgtctgca

SEQ ID NO: 39901 - DNA, 15 bp, Homo sapiens
gaaatagctgtctgc

SEQ ID NO: 39902 - DNA, 15 bp, Homo sapiens
cgaaatagctgtctg

SEQ ID NO: 39903 - DNA, 15 bp, Homo sapiens
gcgaaatagctgtct

SEQ ID NO: 39904 - DNA, 15 bp, Homo sapiens
tgcgaaatagctgtc

SEQ ID NO: 39905 - DNA, 15 bp, Homo sapiens
gtgcgaaatagctgt

SEQ ID NO: 39906 - DNA, 15 bp, Homo sapiens
agtgcgaaatagctg

SEQ ID NO: 39907 - DNA, 15 bp, Homo sapiens
cagtgcgaaatagct

SEQ ID NO: 39908 - DNA, 15 bp, Homo sapiens
acagtgcgaaatagc

SEQ ID NO: 39909 - DNA, 15 bp, Homo sapiens
tacagtgcgaaatag

SEQ ID NO: 39910 - DNA, 15 bp, Homo sapiens
atacagtgcgaaata

SEQ ID NO: 39911 - DNA, 15 bp, Homo sapiens
aatacagtgcgaaat

SEQ ID NO: 39912 - DNA, 15 bp, Homo sapiens
taatacagtgcgaaa

SEQ ID NO: 39913 - DNA, 15 bp, Homo sapiens
ttaatacagtgcgaa

SEQ ID NO: 39914 - DNA, 15 bp, Homo sapiens
tttaatacagtgcga

SEQ ID NO: 39915 - DNA, 15 bp, Homo sapiens
atttaatacagtgcg

SEQ ID NO: 39916 - DNA, 15 bp, Homo sapiens
catttaatacagtgc

SEQ ID NO: 39917 - DNA, 15 bp, Homo sapiens
acatttaatacagtg

SEQ ID NO: 39918 - DNA, 15 bp, Homo sapiens
tacatttaatacagt

SEQ ID NO: 39919 - DNA, 15 bp, Homo sapiens
ttacatttaatacag

SEQ ID NO: 39920 - DNA, 15 bp, Homo sapiens
gttacatttaataca

SEQ ID NO: 39921 - DNA, 15 bp, Homo sapiens
agttacatttaatac

SEQ ID NO: 39922 - DNA, 15 bp, Homo sapiens
aagttacatttaata

SEQ ID NO: 39923 - DNA, 15 bp, Homo sapiens
taagttacatttaat

SEQ ID NO: 39924 - DNA, 15 bp, Homo sapiens
ataagttacatttaa

SEQ ID NO: 39925 - DNA, 15 bp, Homo sapiens
aataagttacattta

SEQ ID NO: 39926 - DNA, 15 bp, Homo sapiens
aaataagttacattt

SEQ ID NO: 39927 - DNA, 15 bp, Homo sapiens
taaataagttacatt

SEQ ID NO: 39928 - DNA, 15 bp, Homo sapiens
ttaaataagttacat

SEQ ID NO: 39929 - DNA, 15 bp, Homo sapiens
attaaataagttaca

SEQ ID NO: 39930 - DNA, 15 bp, Homo sapiens
cattaaataagttac

SEQ ID NO: 39931 - DNA, 15 bp, Homo sapiens
tcattaaataagtta

SEQ ID NO: 39932 - DNA, 15 bp, Homo sapiens
ttcattaaataagtt

SEQ ID NO: 39933 - DNA, 15 bp, Homo sapiens
tttcattaaataagt

SEQ ID NO: 39934 - DNA, 15 bp, Homo sapiens
atttcattaaataag

SEQ ID NO: 39935 - DNA, 15 bp, Homo sapiens
gatttcattaaataa

SEQ ID NO: 39936 - DNA, 15 bp, Homo sapiens
tgatttcattaaata

SEQ ID NO: 39937 - DNA, 15 bp, Homo sapiens
ctgatttcattaaat

SEQ ID NO: 39938 - DNA, 15 bp, Homo sapiens
tctgatttcattaaa

SEQ ID NO: 39939 - DNA, 15 bp, Homo sapiens
ttctgatttcattaa

SEQ ID NO: 39940 - DNA, 15 bp, Homo sapiens
cttctgatttcatta

SEQ ID NO: 39941 - DNA, 15 bp, Homo sapiens
gcttctgatttcatt

SEQ ID NO: 39942 - DNA, 15 bp, Homo sapiens
tgcttctgatttcat

SEQ ID NO: 39943 - DNA, 15 bp, Homo sapiens
ctgcttctgatttca

SEQ ID NO: 39944 - DNA, 15 bp, Homo sapiens
actgcttctgatttc

SEQ ID NO: 39945 - DNA, 15 bp, Homo sapiens
tactgcttctgattt

SEQ ID NO: 39946 - DNA, 15 bp, Homo sapiens
ctactgcttctgatt

SEQ ID NO: 39947 - DNA, 15 bp, Homo sapiens
tctactgcttctgat

SEQ ID NO: 39948 - DNA, 15 bp, Homo sapiens
gtctactgcttctga

SEQ ID NO: 39949 - DNA, 15 bp, Homo sapiens
tgtctactgcttctg

SEQ ID NO: 39950 - DNA, 15 bp, Homo sapiens
ctgtctactgcttct

SEQ ID NO: 39951 - DNA, 15 bp, Homo sapiens
tctgtctactgcttc

SEQ ID NO: 39952 - DNA, 15 bp, Homo sapiens
atctgtctactgctt

SEQ ID NO: 39953 - DNA, 15 bp, Homo sapiens
catctgtctactgct

SEQ ID NO: 39954 - DNA, 15 bp, Homo sapiens
acatctgtctactgc

SEQ ID NO: 39955 - DNA, 15 bp, Homo sapiens
aacatctgtctactg

SEQ ID NO: 39956 - DNA, 15 bp, Homo sapiens
caacatctgtctact

SEQ ID NO: 39957 - DNA, 15 bp, Homo sapiens
ccaacatctgtctac

SEQ ID NO: 39958 - DNA, 15 bp, Homo sapiens
accaacatctgtcta

SEQ ID NO: 39959 - DNA, 15 bp, Homo sapiens
caccaacatctgtct

SEQ ID NO: 39960 - DNA, 15 bp, Homo sapiens
gcaccaacatctgtc

SEQ ID NO: 39961 - DNA, 15 bp, Homo sapiens
tgcaccaacatctgt

SEQ ID NO: 39962 - DNA, 15 bp, Homo sapiens
ttgcaccaacatctg

SEQ ID NO: 39963 - DNA, 15 bp, Homo sapiens
attgcaccaacatct

SEQ ID NO: 39964 - DNA, 15 bp, Homo sapiens
tattgcaccaacatc

SEQ ID NO: 39965 - DNA, 15 bp, Homo sapiens
gtattgcaccaacat

SEQ ID NO: 39966 - DNA, 15 bp, Homo sapiens
tgtattgcaccaaca

SEQ ID NO: 39967 - DNA, 15 bp, Homo sapiens
ttgtattgcaccaac

SEQ ID NO: 39968 - DNA, 15 bp, Homo sapiens
tttgtattgcaccaa

SEQ ID NO: 39969 - DNA, 15 bp, Homo sapiens
atttgtattgcacca

SEQ ID NO: 39970 - DNA, 15 bp, Homo sapiens
tatttgtattgcacc

SEQ ID NO: 39971 - DNA, 15 bp, Homo sapiens
atatttgtattgcac

SEQ ID NO: 39972 - DNA, 15 bp, Homo sapiens
aatatttgtattgca

SEQ ID NO: 39973 - DNA, 15 bp, Homo sapiens
caatatttgtattgc

SEQ ID NO: 39974 - DNA, 15 bp, Homo sapiens
acaatatttgtattg

SEQ ID NO: 39975 - DNA, 15 bp, Homo sapiens
cacaatatttgtatt

SEQ ID NO: 39976 - DNA, 15 bp, Homo sapiens
tcacaatatttgtat

SEQ ID NO: 39977 - DNA, 15 bp, Homo sapiens
atcacaatatttgta

SEQ ID NO: 39978 - DNA, 15 bp, Homo sapiens
catcacaatatttgt

SEQ ID NO: 39979 - DNA, 15 bp, Homo sapiens
gcatcacaatatttg

SEQ ID NO: 39980 - DNA, 15 bp, Homo sapiens
tgcatcacaatattt

SEQ ID NO: 39981 - DNA, 15 bp, Homo sapiens
atgcatcacaatatt

SEQ ID NO: 39982 - DNA, 15 bp, Homo sapiens
aatgcatcacaatat

SEQ ID NO: 39983 - DNA, 15 bp, Homo sapiens
aaatgcatcacaata

SEQ ID NO: 39984 - DNA, 15 bp, Homo sapiens
taaatgcatcacaat

SEQ ID NO: 39985 - DNA, 15 bp, Homo sapiens
ataaatgcatcacaa

SEQ ID NO: 39986 - DNA, 15 bp, Homo sapiens
gataaatgcatcaca

SEQ ID NO: 39987 - DNA, 15 bp, Homo sapiens
agataaatgcatcac

SEQ ID NO: 39988 - DNA, 15 bp, Homo sapiens
aagataaatgcatca

SEQ ID NO: 39989 - DNA, 15 bp, Homo sapiens
taagataaatgcatc

SEQ ID NO: 39990 - DNA, 15 bp, Homo sapiens
ttaagataaatgcat

SEQ ID NO: 39991 - DNA, 15 bp, Homo sapiens
attaagataaatgca

SEQ ID NO: 39992 - DNA, 15 bp, Homo sapiens
tattaagataaatgc

SEQ ID NO: 39993 - DNA, 15 bp, Homo sapiens
ttattaagataaatg

SEQ ID NO: 39994 - DNA, 15 bp, Homo sapiens
tttattaagataaat

SEQ ID NO: 39995 - DNA, 15 bp, Homo sapiens
ttttattaagataaa

SEQ ID NO: 39996 - DNA, 15 bp, Homo sapiens
attttattaagataa

SEQ ID NO: 39997 - DNA, 15 bp, Homo sapiens
cattttattaagata

SEQ ID NO: 39998 - DNA, 15 bp, Homo sapiens
gcattttattaagat

SEQ ID NO: 39999 - DNA, 15 bp, Homo sapiens
agcattttattaaga

SEQ ID NO: 40000 - DNA, 15 bp, Homo sapiens
tagcattttattaag

SEQ ID NO: 40001 - DNA, 15 bp, Homo sapiens
ttagcattttattaa

SEQ ID NO: 40002 - DNA, 15 bp, Homo sapiens
tttagcattttatta

SEQ ID NO: 40003 - DNA, 15 bp, Homo sapiens
atttagcattttatt

SEQ ID NO: 40004 - DNA, 15 bp, Homo sapiens
catttagcattttat

SEQ ID NO: 40005 - DNA, 15 bp, Homo sapiens
acatttagcatttta

SEQ ID NO: 40006 - DNA, 15 bp, Homo sapiens
gacatttagcatttt

SEQ ID NO: 40007 - DNA, 15 bp, Homo sapiens
tgacatttagcattt

SEQ ID NO: 40008 - DNA, 15 bp, Homo sapiens
ttgacatttagcatt

SEQ ID NO: 40009 - DNA, 15 bp, Homo sapiens
attgacatttagcat

SEQ ID NO: 40010 - DNA, 15 bp, Homo sapiens
aattgacatttagca

SEQ ID NO: 40011 - DNA, 15 bp, Homo sapiens
aaattgacatttagc

SEQ ID NO: 40012 - DNA, 15 bp, Homo sapiens
taaattgacatttag

SEQ ID NO: 40013 - DNA, 15 bp, Homo sapiens
ataaattgacattta

SEQ ID NO: 40014 - DNA, 15 bp, Homo sapiens
gataaattgacattt

SEQ ID NO: 40015 - DNA, 15 bp, Homo sapiens
tgataaattgacatt

SEQ ID NO: 40016 - DNA, 15 bp, Homo sapiens
gtgataaattgacat

SEQ ID NO: 40017 - DNA, 15 bp, Homo sapiens
agtgataaattgaca

SEQ ID NO: 40018 - DNA, 15 bp, Homo sapiens
cagtgataaattgac

SEQ ID NO: 40019 - DNA, 15 bp, Homo sapiens
gcagtgataaattga

SEQ ID NO: 40020 - DNA, 15 bp, Homo sapiens
cgcagtgataaattg

SEQ ID NO: 40021 - DNA, 15 bp, Homo sapiens
gcgcagtgataaatt

SEQ ID NO: 40022 - DNA, 15 bp, Homo sapiens
tgcgcagtgataaat

SEQ ID NO: 40023 - DNA, 15 bp, Homo sapiens
atgcgcagtgataaa

SEQ ID NO: 40024 - DNA, 15 bp, Homo sapiens
catgcgcagtgataa

SEQ ID NO: 40025 - DNA, 15 bp, Homo sapiens
acatgcgcagtgata

SEQ ID NO: 40026 - DNA, 15 bp, Homo sapiens
aacatgcgcagtgat

SEQ ID NO: 40027 - DNA, 15 bp, Homo sapiens
aaacatgcgcagtga

SEQ ID NO: 40028 - DNA, 15 bp, Homo sapiens
caaacatgcgcagtg

SEQ ID NO: 40029 - DNA, 15 bp, Homo sapiens
tcaaacatgcgcagt

SEQ ID NO: 40030 - DNA, 15 bp, Homo sapiens
gtcaaacatgcgcag

SEQ ID NO: 40031 - DNA, 15 bp, Homo sapiens
agtcaaacatgcgca

SEQ ID NO: 40032 - DNA, 15 bp, Homo sapiens
aagtcaaacatgcgc

SEQ ID NO: 40033 - DNA, 15 bp, Homo sapiens
aaagtcaaacatgcg

SEQ ID NO: 40034 - DNA, 15 bp, Homo sapiens
taaagtcaaacatgc

SEQ ID NO: 40035 - DNA, 15 bp, Homo sapiens
ctaaagtcaaacatg

SEQ ID NO: 40036 - DNA, 15 bp, Homo sapiens
tctaaagtcaaacat

SEQ ID NO: 40037 - DNA, 15 bp, Homo sapiens
gtctaaagtcaaaca

SEQ ID NO: 40038 - DNA, 15 bp, Homo sapiens
agtctaaagtcaaac

SEQ ID NO: 40039 - DNA, 15 bp, Homo sapiens
cagtctaaagtcaaa

SEQ ID NO: 40040 - DNA, 15 bp, Homo sapiens
acagtctaaagtcaa

SEQ ID NO: 40041 - DNA, 15 bp, Homo sapiens
tacagtctaaagtca

SEQ ID NO: 40042 - DNA, 15 bp, Homo sapiens
ttacagtctaaagtc

SEQ ID NO: 40043 - DNA, 15 bp, Homo sapiens
tttacagtctaaagt

SEQ ID NO: 40044 - DNA, 15 bp, Homo sapiens
atttacagtctaaag

SEQ ID NO: 40045 - DNA, 15 bp, Homo sapiens
tatttacagtctaaa

SEQ ID NO: 40046 - DNA, 15 bp, Homo sapiens
ctatttacagtctaa

SEQ ID NO: 40047 - DNA, 15 bp, Homo sapiens
tctatttacagtcta

SEQ ID NO: 40048 - DNA, 15 bp, Homo sapiens
ctctatttacagtct

SEQ ID NO: 40049 - DNA, 15 bp, Homo sapiens
tctctatttacagtc

SEQ ID NO: 40050 - DNA, 15 bp, Homo sapiens
atctctatttacagt

SEQ ID NO: 40051 - DNA, 15 bp, Homo sapiens
gatctctatttacag

SEQ ID NO: 40052 - DNA, 15 bp, Homo sapiens
tgatctctatttaca

SEQ ID NO: 40053 - DNA, 15 bp, Homo sapiens
ctgatctctatttac

SEQ ID NO: 40054 - DNA, 15 bp, Homo sapiens
actgatctctattta

SEQ ID NO: 40055 - DNA, 15 bp, Homo sapiens
aactgatctctattt

SEQ ID NO: 40056 - DNA, 15 bp, Homo sapiens
aaactgatctctatt

SEQ ID NO: 40057 - DNA, 15 bp, Homo sapiens
caaactgatctctat

SEQ ID NO: 40058 - DNA, 15 bp, Homo sapiens
acaaactgatctcta

SEQ ID NO: 40059 - DNA, 15 bp, Homo sapiens
aacaaactgatctct

SEQ ID NO: 40060 - DNA, 15 bp, Homo sapiens
aaacaaactgatctc

SEQ ID NO: 40061 - DNA, 15 bp, Homo sapiens
gaaacaaactgatct

SEQ ID NO: 40062 - DNA, 15 bp, Homo sapiens
agaaacaaactgatc

SEQ ID NO: 40063 - DNA, 15 bp, Homo sapiens
aagaaacaaactgat

SEQ ID NO: 40064 - DNA, 15 bp, Homo sapiens
aaagaaacaaactga

SEQ ID NO: 40065 - DNA, 15 bp, Homo sapiens
gaaagaaacaaactg

SEQ ID NO: 40066 - DNA, 15 bp, Homo sapiens
agaaagaaacaaact

SEQ ID NO: 40067 - DNA, 15 bp, Homo sapiens
cagaaagaaacaaac

SEQ ID NO: 40068 - DNA, 15 bp, Homo sapiens
acagaaagaaacaaa

SEQ ID NO: 40069 - DNA, 15 bp, Homo sapiens
cacagaaagaaacaa

SEQ ID NO: 40070 - DNA, 15 bp, Homo sapiens
gcacagaaagaaaca

SEQ ID NO: 40071 - DNA, 15 bp, Homo sapiens
agcacagaaagaaac

SEQ ID NO: 40072 - DNA, 15 bp, Homo sapiens
cagcacagaaagaaa

SEQ ID NO: 40073 - DNA, 15 bp, Homo sapiens
ccagcacagaaagaa

SEQ ID NO: 40074 - DNA, 15 bp, Homo sapiens
accagcacagaaaga

SEQ ID NO: 40075 - DNA, 15 bp, Homo sapiens
taccagcacagaaag

SEQ ID NO: 40076 - DNA, 15 bp, Homo sapiens
ttaccagcacagaaa

SEQ ID NO: 40077 - DNA, 15 bp, Homo sapiens
gttaccagcacagaa

SEQ ID NO: 40078 - DNA, 15 bp, Homo sapiens
tgttaccagcacaga

SEQ ID NO: 40079 - DNA, 15 bp, Homo sapiens
ttgttaccagcacag

SEQ ID NO: 40080 - DNA, 15 bp, Homo sapiens
attgttaccagcaca

SEQ ID NO: 40081 - DNA, 15 bp, Homo sapiens
cattgttaccagcac

SEQ ID NO: 40082 - DNA, 15 bp, Homo sapiens
tcattgttaccagca

SEQ ID NO: 40083 - DNA, 15 bp, Homo sapiens
ctcattgttaccagc

SEQ ID NO: 40084 - DNA, 15 bp, Homo sapiens
gctcattgttaccag

SEQ ID NO: 40085 - DNA, 15 bp, Homo sapiens
cgctcattgttacca

SEQ ID NO: 40086 - DNA, 15 bp, Homo sapiens
acgctcattgttacc

SEQ ID NO: 40087 - DNA, 15 bp, Homo sapiens
gacgctcattgttac

SEQ ID NO: 40088 - DNA, 15 bp, Homo sapiens
cgacgctcattgtta

SEQ ID NO: 40089 - DNA, 15 bp, Homo sapiens
gcgacgctcattgtt

SEQ ID NO: 40090 - DNA, 15 bp, Homo sapiens
tgcgacgctcattgt

SEQ ID NO: 40091 - DNA, 15 bp, Homo sapiens
gtgcgacgctcattg

SEQ ID NO: 40092 - DNA, 15 bp, Homo sapiens
tgtgcgacgctcatt

SEQ ID NO: 40093 - DNA, 15 bp, Homo sapiens
ctgtgcgacgctcat

SEQ ID NO: 40094 - DNA, 15 bp, Homo sapiens
tctgtgcgacgctca

SEQ ID NO: 40095 - DNA, 15 bp, Homo sapiens
gtctgtgcgacgctc

SEQ ID NO: 40096 - DNA, 15 bp, Homo sapiens
tgtctgtgcgacgct

SEQ ID NO: 40097 - DNA, 15 bp, Homo sapiens
atgtctgtgcgacgc

SEQ ID NO: 40098 - DNA, 15 bp, Homo sapiens
catgtctgtgcgacg

SEQ ID NO: 40099 - DNA, 15 bp, Homo sapiens
ccatgtctgtgcgac

SEQ ID NO: 40100 - DNA, 15 bp, Homo sapiens
accatgtctgtgcga

SEQ ID NO: 40101 - DNA, 15 bp, Homo sapiens
aaccatgtctgtgcg

SEQ ID NO: 40102 - DNA, 15 bp, Homo sapiens
aaaccatgtctgtgc

SEQ ID NO: 40103 - DNA, 15 bp, Homo sapiens
gaaaccatgtctgtg

SEQ ID NO: 40104 - DNA, 15 bp, Homo sapiens
tgaaaccatgtctgt

SEQ ID NO: 40105 - DNA, 15 bp, Homo sapiens
ctgaaaccatgtctg

SEQ ID NO: 40106 - DNA, 15 bp, Homo sapiens
cctgaaaccatgtct

SEQ ID NO: 40107 - DNA, 15 bp, Homo sapiens
acctgaaaccatgtc

SEQ ID NO: 40108 - DNA, 15 bp, Homo sapiens
tacctgaaaccatgt

SEQ ID NO: 40109 - DNA, 15 bp, Homo sapiens
ttacctgaaaccatg

SEQ ID NO: 40110 - DNA, 15 bp, Homo sapiens
tttacctgaaaccat

SEQ ID NO: 40111 - DNA, 15 bp, Homo sapiens
atttacctgaaacca

SEQ ID NO: 40112 - DNA, 15 bp, Homo sapiens
tatttacctgaaacc

SEQ ID NO: 40113 - DNA, 15 bp, Homo sapiens
ttatttacctgaaac

SEQ ID NO: 40114 - DNA, 15 bp, Homo sapiens
tttatttacctgaaa

SEQ ID NO: 40115 - DNA, 15 bp, Homo sapiens
atttatttacctgaa

SEQ ID NO: 40116 - DNA, 15 bp, Homo sapiens
gatttatttacctga

SEQ ID NO: 40117 - DNA, 15 bp, Homo sapiens
agatttatttacctg

SEQ ID NO: 40118 - DNA, 15 bp, Homo sapiens
tagatttatttacct

SEQ ID NO: 40119 - DNA, 15 bp, Homo sapiens
atagatttatttacc

SEQ ID NO: 40120 - DNA, 15 bp, Homo sapiens
aatagatttatttac

SEQ ID NO: 40121 - DNA, 15 bp, Homo sapiens
gaatagatttattta

SEQ ID NO: 40122 - DNA, 15 bp, Homo sapiens
agaatagatttattt

SEQ ID NO: 40123 - DNA, 15 bp, Homo sapiens
tagaatagatttatt

SEQ ID NO: 40124 - DNA, 15 bp, Homo sapiens
atagaatagatttat

SEQ ID NO: 40125 - DNA, 15 bp, Homo sapiens
catagaatagattta

SEQ ID NO: 40126 - DNA, 15 bp, Homo sapiens
tcatagaatagattt

SEQ ID NO: 40127 - DNA, 15 bp, Homo sapiens
atcatagaatagatt

SEQ ID NO: 40128 - DNA, 15 bp, Homo sapiens
tatcatagaatagat

SEQ ID NO: 40129 - DNA, 15 bp, Homo sapiens
ttatcatagaataga

SEQ ID NO: 40130 - DNA, 15 bp, Homo sapiens
tttatcatagaatag

SEQ ID NO: 40131 - DNA, 15 bp, Homo sapiens
atttatcatagaata

SEQ ID NO: 40132 - DNA, 15 bp, Homo sapiens
aatttatcatagaat

SEQ ID NO: 40133 - DNA, 15 bp, Homo sapiens
gaatttatcatagaa

SEQ ID NO: 40134 - DNA, 15 bp, Homo sapiens
agaatttatcataga

SEQ ID NO: 40135 - DNA, 15 bp, Homo sapiens
gagaatttatcatag

SEQ ID NO: 40136 - DNA, 15 bp, Homo sapiens
tgagaatttatcata

SEQ ID NO: 40137 - DNA, 15 bp, Homo sapiens
ctgagaatttatcat

SEQ ID NO: 40138 - DNA, 15 bp, Homo sapiens
actgagaatttatca

SEQ ID NO: 40139 - DNA, 15 bp, Homo sapiens
cactgagaatttatc

SEQ ID NO: 40140 - DNA, 15 bp, Homo sapiens
acactgagaatttat

SEQ ID NO: 40141 - DNA, 15 bp, Homo sapiens
cacactgagaattta

SEQ ID NO: 40142 - DNA, 15 bp, Homo sapiens
ccacactgagaattt

SEQ ID NO: 40143 - DNA, 15 bp, Homo sapiens
accacactgagaatt

SEQ ID NO: 40144 - DNA, 15 bp, Homo sapiens
caccacactgagaat

SEQ ID NO: 40145 - DNA, 15 bp, Homo sapiens
ccaccacactgagaa

SEQ ID NO: 40146 - DNA, 15 bp, Homo sapiens
accaccacactgaga

SEQ ID NO: 40147 - DNA, 15 bp, Homo sapiens
caccaccacactgag

SEQ ID NO: 40148 - DNA, 15 bp, Homo sapiens
tcaccaccacactga

SEQ ID NO: 40149 - DNA, 15 bp, Homo sapiens
gtcaccaccacactg

SEQ ID NO: 40150 - DNA, 15 bp, Homo sapiens
agtcaccaccacact

SEQ ID NO: 40151 - DNA, 15 bp, Homo sapiens
cagtcaccaccacac

SEQ ID NO: 40152 - DNA, 15 bp, Homo sapiens
acagtcaccaccaca

SEQ ID NO: 40153 - DNA, 15 bp, Homo sapiens
aacagtcaccaccac

SEQ ID NO: 40154 - DNA, 15 bp, Homo sapiens
gaacagtcaccacca

SEQ ID NO: 40155 - DNA, 15 bp, Homo sapiens
agaacagtcaccacc

SEQ ID NO: 40156 - DNA, 15 bp, Homo sapiens
cagaacagtcaccac

SEQ ID NO: 40157 - DNA, 15 bp, Homo sapiens
acagaacagtcacca

SEQ ID NO: 40158 - DNA, 15 bp, Homo sapiens
cacagaacagtcacc

SEQ ID NO: 40159 - DNA, 15 bp, Homo sapiens
ccacagaacagtcac

SEQ ID NO: 40160 - DNA, 15 bp, Homo sapiens
cccacagaacagtca

SEQ ID NO: 40161 - DNA, 15 bp, Homo sapiens
tcccacagaacagtc

SEQ ID NO: 40162 - DNA, 15 bp, Homo sapiens
ctcccacagaacagt

SEQ ID NO: 40163 - DNA, 15 bp, Homo sapiens
cctcccacagaacag

SEQ ID NO: 40164 - DNA, 15 bp, Homo sapiens
ccctcccacagaaca

SEQ ID NO: 40165 - DNA, 15 bp, Homo sapiens
cccctcccacagaac

SEQ ID NO: 40166 - DNA, 15 bp, Homo sapiens
ccccctcccacagaa

SEQ ID NO: 40167 - DNA, 15 bp, Homo sapiens
tccccctcccacaga

SEQ ID NO: 40168 - DNA, 15 bp, Homo sapiens
gtccccctcccacag

SEQ ID NO: 40169 - DNA, 15 bp, Homo sapiens
agtccccctcccaca

SEQ ID NO: 40170 - DNA, 15 bp, Homo sapiens
cagtccccctcccac

SEQ ID NO: 40171 - DNA, 15 bp, Homo sapiens
tcagtccccctccca

SEQ ID NO: 40172 - DNA, 15 bp, Homo sapiens
atcagtccccctccc

SEQ ID NO: 40173 - DNA, 15 bp, Homo sapiens
catcagtccccctcc

SEQ ID NO: 40174 - DNA, 15 bp, Homo sapiens
ccatcagtccccctc

SEQ ID NO: 40175 - DNA, 15 bp, Homo sapiens
cccatcagtccccct

SEQ ID NO: 40176 - DNA, 15 bp, Homo sapiens
gcccatcagtccccc

SEQ ID NO: 40177 - DNA, 15 bp, Homo sapiens
tgcccatcagtcccc

SEQ ID NO: 40178 - DNA, 15 bp, Homo sapiens
gtgcccatcagtccc

SEQ ID NO: 40179 - DNA, 15 bp, Homo sapiens
ggtgcccatcagtcc

SEQ ID NO: 40180 - DNA, 15 bp, Homo sapiens
tggtgcccatcagtc

SEQ ID NO: 40181 - DNA, 15 bp, Homo sapiens
ttggtgcccatcagt

SEQ ID NO: 40182 - DNA, 15 bp, Homo sapiens
cttggtgcccatcag

SEQ ID NO: 40183 - DNA, 15 bp, Homo sapiens
ccttggtgcccatca

SEQ ID NO: 40184 - DNA, 15 bp, Homo sapiens
cccttggtgcccatc

SEQ ID NO: 40185 - DNA, 15 bp, Homo sapiens
gcccttggtgcccat

SEQ ID NO: 40186 - DNA, 15 bp, Homo sapiens
ggcccttggtgccca

SEQ ID NO: 40187 - DNA, 15 bp, Homo sapiens
aggcccttggtgccc

SEQ ID NO: 40188 - DNA, 15 bp, Homo sapiens
gaggcccttggtgcc

SEQ ID NO: 40189 - DNA, 15 bp, Homo sapiens
ggaggcccttggtgc

SEQ ID NO: 40190 - DNA, 15 bp, Homo sapiens
tggaggcccttggtg

SEQ ID NO: 40191 - DNA, 15 bp, Homo sapiens
gtggaggcccttggt

SEQ ID NO: 40192 - DNA, 15 bp, Homo sapiens
agtggaggcccttgg

SEQ ID NO: 40193 - DNA, 15 bp, Homo sapiens
gagtggaggcccttg

SEQ ID NO: 40194 - DNA, 15 bp, Homo sapiens
ggagtggaggccctt

SEQ ID NO: 40195 - DNA, 15 bp, Homo sapiens
cggagtggaggccct

SEQ ID NO: 40196 - DNA, 15 bp, Homo sapiens
gcggagtggaggccc

SEQ ID NO: 40197 - DNA, 15 bp, Homo sapiens
tgcggagtggaggcc

SEQ ID NO: 40198 - DNA, 15 bp, Homo sapiens
gtgcggagtggaggc

SEQ ID NO: 40199 - DNA, 15 bp, Homo sapiens
ggtgcggagtggagg

SEQ ID NO: 40200 - DNA, 15 bp, Homo sapiens
gggtgcggagtggag

SEQ ID NO: 40201 - DNA, 15 bp, Homo sapiens
cgggtgcggagtgga

SEQ ID NO: 40202 - DNA, 15 bp, Homo sapiens
ccgggtgcggagtgg

SEQ ID NO: 40203 - DNA, 15 bp, Homo sapiens
cccgggtgcggagtg

SEQ ID NO: 40204 - DNA, 15 bp, Homo sapiens
gcccgggtgcggagt

SEQ ID NO: 40205 - DNA, 15 bp, Homo sapiens
ggcccgggtgcggag

SEQ ID NO: 40206 - DNA, 15 bp, Homo sapiens
aggcccgggtgcgga

SEQ ID NO: 40207 - DNA, 15 bp, Homo sapiens
caggcccgggtgcgg

SEQ ID NO: 40208 - DNA, 15 bp, Homo sapiens
gcaggcccgggtgcg

SEQ ID NO: 40209 - DNA, 15 bp, Homo sapiens
ggcaggcccgggtgc

SEQ ID NO: 40210 - DNA, 15 bp, Homo sapiens
gggcaggcccgggtg

SEQ ID NO: 40211 - DNA, 15 bp, Homo sapiens
ggggcaggcccgggt

SEQ ID NO: 40212 - DNA, 15 bp, Homo sapiens
aggggcaggcccggg

SEQ ID NO: 40213 - DNA, 15 bp, Homo sapiens
gaggggcaggcccgg

SEQ ID NO: 40214 - DNA, 15 bp, Homo sapiens
agaggggcaggcccg

SEQ ID NO: 40215 - DNA, 15 bp, Homo sapiens
tagaggggcaggccc

SEQ ID NO: 40216 - DNA, 15 bp, Homo sapiens
gtagaggggcaggcc

SEQ ID NO: 40217 - DNA, 15 bp, Homo sapiens
tgtagaggggcaggc

SEQ ID NO: 40218 - DNA, 15 bp, Homo sapiens
ctgtagaggggcagg

SEQ ID NO: 40219 - DNA, 15 bp, Homo sapiens
cctgtagaggggcag

SEQ ID NO: 40220 - DNA, 15 bp, Homo sapiens
ccctgtagaggggca

SEQ ID NO: 40221 - DNA, 15 bp, Homo sapiens
tccctgtagaggggc

SEQ ID NO: 40222 - DNA, 15 bp, Homo sapiens
ttccctgtagagggg

SEQ ID NO: 40223 - DNA, 15 bp, Homo sapiens
cttccctgtagaggg

SEQ ID NO: 40224 - DNA, 15 bp, Homo sapiens
gcttccctgtagagg

SEQ ID NO: 40225 - DNA, 15 bp, Homo sapiens
tgcttccctgtagag

SEQ ID NO: 40226 - DNA, 15 bp, Homo sapiens
ctgcttccctgtaga

SEQ ID NO: 40227 - DNA, 15 bp, Homo sapiens
cctgcttccctgtag

SEQ ID NO: 40228 - DNA, 15 bp, Homo sapiens
ccctgcttccctgta

SEQ ID NO: 40229 - DNA, 15 bp, Homo sapiens
cccctgcttccctgt

SEQ ID NO: 40230 - DNA, 15 bp, Homo sapiens
tcccctgcttccctg

SEQ ID NO: 40231 - DNA, 15 bp, Homo sapiens
ctcccctgcttccct

SEQ ID NO: 40232 - DNA, 15 bp, Homo sapiens
cctcccctgcttccc

SEQ ID NO: 40233 - DNA, 15 bp, Homo sapiens
gcctcccctgcttcc

SEQ ID NO: 40234 - DNA, 15 bp, Homo sapiens
agcctcccctgcttc

SEQ ID NO: 40235 - DNA, 15 bp, Homo sapiens
gagcctcccctgctt

SEQ ID NO: 40236 - DNA, 15 bp, Homo sapiens
tgagcctcccctgct

SEQ ID NO: 40237 - DNA, 15 bp, Homo sapiens
ctgagcctcccctgc

SEQ ID NO: 40238 - DNA, 15 bp, Homo sapiens
actgagcctcccctg

SEQ ID NO: 40239 - DNA, 15 bp, Homo sapiens
gactgagcctcccct

SEQ ID NO: 40240 - DNA, 15 bp, Homo sapiens
agactgagcctcccc

SEQ ID NO: 40241 - DNA, 15 bp, Homo sapiens
cagactgagcctccc

SEQ ID NO: 40242 - DNA, 15 bp, Homo sapiens
ccagactgagcctcc

SEQ ID NO: 40243 - DNA, 15 bp, Homo sapiens
cccagactgagcctc

SEQ ID NO: 40244 - DNA, 15 bp, Homo sapiens
gcccagactgagcct

SEQ ID NO: 40245 - DNA, 15 bp, Homo sapiens
tgcccagactgagcc

SEQ ID NO: 40246 - DNA, 15 bp, Homo sapiens
ctgcccagactgagc

SEQ ID NO: 40247 - DNA, 15 bp, Homo sapiens
cctgcccagactgag

SEQ ID NO: 40248 - DNA, 15 bp, Homo sapiens
ccctgcccagactga

SEQ ID NO: 40249 - DNA, 15 bp, Homo sapiens
accctgcccagactg

SEQ ID NO: 40250 - DNA, 15 bp, Homo sapiens
caccctgcccagact

SEQ ID NO: 40251 - DNA, 15 bp, Homo sapiens
ccaccctgcccagac

SEQ ID NO: 40252 - DNA, 15 bp, Homo sapiens
gccaccctgcccaga

SEQ ID NO: 40253 - DNA, 15 bp, Homo sapiens
ggccaccctgcccag

SEQ ID NO: 40254 - DNA, 15 bp, Homo sapiens
tggccaccctgccca

SEQ ID NO: 40255 - DNA, 15 bp, Homo sapiens
atggccaccctgccc

SEQ ID NO: 40256 - DNA, 15 bp, Homo sapiens
catggccaccctgcc

SEQ ID NO: 40257 - DNA, 15 bp, Homo sapiens
acatggccaccctgc

SEQ ID NO: 40258 - DNA, 15 bp, Homo sapiens
cacatggccaccctg

SEQ ID NO: 40259 - DNA, 15 bp, Homo sapiens
tcacatggccaccct

SEQ ID NO: 40260 - DNA, 15 bp, Homo sapiens
gtcacatggccaccc

SEQ ID NO: 40261 - DNA, 15 bp, Homo sapiens
agtcacatggccacc

SEQ ID NO: 40262 - DNA, 15 bp, Homo sapiens
tagtcacatggccac

SEQ ID NO: 40263 - DNA, 15 bp, Homo sapiens
ctagtcacatggcca

SEQ ID NO: 40264 - DNA, 15 bp, Homo sapiens
tctagtcacatggcc

SEQ ID NO: 40265 - DNA, 15 bp, Homo sapiens
ctctagtcacatggc

SEQ ID NO: 40266 - DNA, 15 bp, Homo sapiens
cctctagtcacatgg

SEQ ID NO: 40267 - DNA, 15 bp, Homo sapiens
ccctctagtcacatg

SEQ ID NO: 40268 - DNA, 15 bp, Homo sapiens
cccctctagtcacat

SEQ ID NO: 40269 - DNA, 15 bp, Homo sapiens
tcccctctagtcaca

SEQ ID NO: 40270 - DNA, 15 bp, Homo sapiens
gtcccctctagtcac

SEQ ID NO: 40271 - DNA, 15 bp, Homo sapiens
tgtcccctctagtca

SEQ ID NO: 40272 - DNA, 15 bp, Homo sapiens
ctgtcccctctagtc

SEQ ID NO: 40273 - DNA, 15 bp, Homo sapiens
cctgtcccctctagt

SEQ ID NO: 40274 - DNA, 15 bp, Homo sapiens
tcctgtcccctctag

SEQ ID NO: 40275 - DNA, 15 bp, Homo sapiens
ttcctgtcccctcta

SEQ ID NO: 40276 - DNA, 15 bp, Homo sapiens
gttcctgtcccctct

SEQ ID NO: 40277 - DNA, 15 bp, Homo sapiens
ggttcctgtcccctc

SEQ ID NO: 40278 - DNA, 15 bp, Homo sapiens
aggttcctgtcccct

SEQ ID NO: 40279 - DNA, 15 bp, Homo sapiens
gaggttcctgtcccc

SEQ ID NO: 40280 - DNA, 15 bp, Homo sapiens
agaggttcctgtccc

SEQ ID NO: 40281 - DNA, 15 bp, Homo sapiens
aagaggttcctgtcc

SEQ ID NO: 40282 - DNA, 15 bp, Homo sapiens
caagaggttcctgtc

SEQ ID NO: 40283 - DNA, 15 bp, Homo sapiens
ccaagaggttcctgt

SEQ ID NO: 40284 - DNA, 15 bp, Homo sapiens
tccaagaggttcctg

SEQ ID NO: 40285 - DNA, 15 bp, Homo sapiens
gtccaagaggttcct

SEQ ID NO: 40286 - DNA, 15 bp, Homo sapiens
agtccaagaggttcc

SEQ ID NO: 40287 - DNA, 15 bp, Homo sapiens
gagtccaagaggttc

SEQ ID NO: 40288 - DNA, 15 bp, Homo sapiens
cgagtccaagaggtt

SEQ ID NO: 40289 - DNA, 15 bp, Homo sapiens
tcgagtccaagaggt

SEQ ID NO: 40290 - DNA, 15 bp, Homo sapiens
gtcgagtccaagagg

SEQ ID NO: 40291 - DNA, 15 bp, Homo sapiens
agtcgagtccaagag

SEQ ID NO: 40292 - DNA, 15 bp, Homo sapiens
aagtcgagtccaaga

SEQ ID NO: 40293 - DNA, 15 bp, Homo sapiens
gaagtcgagtccaag

SEQ ID NO: 40294 - DNA, 15 bp, Homo sapiens
tgaagtcgagtccaa

SEQ ID NO: 40295 - DNA, 15 bp, Homo sapiens
gtgaagtcgagtcca

SEQ ID NO: 40296 - DNA, 15 bp, Homo sapiens
tgtgaagtcgagtcc

SEQ ID NO: 40297 - DNA, 15 bp, Homo sapiens
ctgtgaagtcgagtc

SEQ ID NO: 40298 - DNA, 15 bp, Homo sapiens
actgtgaagtcgagt

SEQ ID NO: 40299 - DNA, 15 bp, Homo sapiens
tactgtgaagtcgag

SEQ ID NO: 40300 - DNA, 15 bp, Homo sapiens
ctactgtgaagtcga

SEQ ID NO: 40301 - DNA, 15 bp, Homo sapiens
tctactgtgaagtcg

SEQ ID NO: 40302 - DNA, 15 bp, Homo sapiens
gtctactgtgaagtc

SEQ ID NO: 40303 - DNA, 15 bp, Homo sapiens
tgtctactgtgaagt

SEQ ID NO: 40304 - DNA, 15 bp, Homo sapiens
ctgtctactgtgaag

SEQ ID NO: 40305 - DNA, 15 bp, Homo sapiens
cctgtctactgtgaa

SEQ ID NO: 40306 - DNA, 15 bp, Homo sapiens
gcctgtctactgtga

SEQ ID NO: 40307 - DNA, 15 bp, Homo sapiens
agcctgtctactgtg

SEQ ID NO: 40308 - DNA, 15 bp, Homo sapiens
cagcctgtctactgt

SEQ ID NO: 40309 - DNA, 15 bp, Homo sapiens
tcagcctgtctactg

SEQ ID NO: 40310 - DNA, 15 bp, Homo sapiens
gtcagcctgtctact

SEQ ID NO: 40311 - DNA, 15 bp, Homo sapiens
agtcagcctgtctac

SEQ ID NO: 40312 - DNA, 15 bp, Homo sapiens
cagtcagcctgtcta

SEQ ID NO: 40313 - DNA, 15 bp, Homo sapiens
ccagtcagcctgtct

SEQ ID NO: 40314 - DNA, 15 bp, Homo sapiens
gccagtcagcctgtc

SEQ ID NO: 40315 - DNA, 15 bp, Homo sapiens
tgccagtcagcctgt

SEQ ID NO: 40316 - DNA, 15 bp, Homo sapiens
ctgccagtcagcctg

SEQ ID NO: 40317 - DNA, 15 bp, Homo sapiens
gctgccagtcagcct

SEQ ID NO: 40318 - DNA, 15 bp, Homo sapiens
tgctgccagtcagcc

SEQ ID NO: 40319 - DNA, 15 bp, Homo sapiens
ctgctgccagtcagc

SEQ ID NO: 40320 - DNA, 15 bp, Homo sapiens
cctgctgccagtcag

SEQ ID NO: 40321 - DNA, 15 bp, Homo sapiens
acctgctgccagtca

SEQ ID NO: 40322 - DNA, 15 bp, Homo sapiens
gacctgctgccagtc

SEQ ID NO: 40323 - DNA, 15 bp, Homo sapiens
ggacctgctgccagt

SEQ ID NO: 40324 - DNA, 15 bp, Homo sapiens
cggacctgctgccag

SEQ ID NO: 40325 - DNA, 15 bp, Homo sapiens
gcggacctgctgcca

SEQ ID NO: 40326 - DNA, 15 bp, Homo sapiens
ggcggacctgctgcc

SEQ ID NO: 40327 - DNA, 15 bp, Homo sapiens
gggcggacctgctgc

SEQ ID NO: 40328 - DNA, 15 bp, Homo sapiens
tgggcggacctgctg

SEQ ID NO: 40329 - DNA, 15 bp, Homo sapiens
atgggcggacctgct

SEQ ID NO: 40330 - DNA, 15 bp, Homo sapiens
catgggcggacctgc

SEQ ID NO: 40331 - DNA, 15 bp, Homo sapiens
acatgggcggacctg

SEQ ID NO: 40332 - DNA, 15 bp, Homo sapiens
cacatgggcggacct

SEQ ID NO: 40333 - DNA, 15 bp, Homo sapiens
tcacatgggcggacc

SEQ ID NO: 40334 - DNA, 15 bp, Homo sapiens
ttcacatgggcggac

SEQ ID NO: 40335 - DNA, 15 bp, Homo sapiens
cttcacatgggcgga

SEQ ID NO: 40336 - DNA, 15 bp, Homo sapiens
gcttcacatgggcgg

SEQ ID NO: 40337 - DNA, 15 bp, Homo sapiens
ggcttcacatgggcg

SEQ ID NO: 40338 - DNA, 15 bp, Homo sapiens
gggcttcacatgggc

SEQ ID NO: 40339 - DNA, 15 bp, Homo sapiens
tgggcttcacatggg

SEQ ID NO: 40340 - DNA, 15 bp, Homo sapiens
gtgggcttcacatgg

SEQ ID NO: 40341 - DNA, 15 bp, Homo sapiens
ggtgggcttcacatg

SEQ ID NO: 40342 - DNA, 15 bp, Homo sapiens
gggtgggcttcacat

SEQ ID NO: 40343 - DNA, 15 bp, Homo sapiens
agggtgggcttcaca

SEQ ID NO: 40344 - DNA, 15 bp, Homo sapiens
cagggtgggcttcac

SEQ ID NO: 40345 - DNA, 15 bp, Homo sapiens
ccagggtgggcttca

SEQ ID NO: 40346 - DNA, 15 bp, Homo sapiens
gccagggtgggcttc

SEQ ID NO: 40347 - DNA, 15 bp, Homo sapiens
agccagggtgggctt

SEQ ID NO: 40348 - DNA, 15 bp, Homo sapiens
gagccagggtgggct

SEQ ID NO: 40349 - DNA, 15 bp, Homo sapiens
ggagccagggtgggc

SEQ ID NO: 40350 - DNA, 15 bp, Homo sapiens
gggagccagggtggg

SEQ ID NO: 40351 - DNA, 15 bp, Homo sapiens
agggagccagggtgg

SEQ ID NO: 40352 - DNA, 15 bp, Homo sapiens
tagggagccagggtg

SEQ ID NO: 40353 - DNA, 15 bp, Homo sapiens
gtagggagccagggt

SEQ ID NO: 40354 - DNA, 15 bp, Homo sapiens
ggtagggagccaggg

SEQ ID NO: 40355 - DNA, 15 bp, Homo sapiens
gggtagggagccagg

SEQ ID NO: 40356 - DNA, 15 bp, Homo sapiens
agggtagggagccag

SEQ ID NO: 40357 - DNA, 15 bp, Homo sapiens
aagggtagggagcca

SEQ ID NO: 40358 - DNA, 15 bp, Homo sapiens
aaagggtagggagcc

SEQ ID NO: 40359 - DNA, 15 bp, Homo sapiens
taaagggtagggagc

SEQ ID NO: 40360 - DNA, 15 bp, Homo sapiens
ttaaagggtagggag

SEQ ID NO: 40361 - DNA, 15 bp, Homo sapiens
cttaaagggtaggga

SEQ ID NO: 40362 - DNA, 15 bp, Homo sapiens
ccttaaagggtaggg

SEQ ID NO: 40363 - DNA, 15 bp, Homo sapiens
tccttaaagggtagg

SEQ ID NO: 40364 - DNA, 15 bp, Homo sapiens
atccttaaagggtag

SEQ ID NO: 40365 - DNA, 15 bp, Homo sapiens
catccttaaagggta

SEQ ID NO: 40366 - DNA, 15 bp, Homo sapiens
ccatccttaaagggt

SEQ ID NO: 40367 - DNA, 15 bp, Homo sapiens
cccatccttaaaggg

SEQ ID NO: 40368 - DNA, 15 bp, Homo sapiens
ccccatccttaaagg

SEQ ID NO: 40369 - DNA, 15 bp, Homo sapiens
cccccatccttaaag

SEQ ID NO: 40370 - DNA, 15 bp, Homo sapiens
tcccccatccttaaa

SEQ ID NO: 40371 - DNA, 15 bp, Homo sapiens
ttcccccatccttaa

SEQ ID NO: 40372 - DNA, 15 bp, Homo sapiens
cttcccccatcctta

SEQ ID NO: 40373 - DNA, 15 bp, Homo sapiens
gcttcccccatcctt

SEQ ID NO: 40374 - DNA, 15 bp, Homo sapiens
agcttcccccatcct

SEQ ID NO: 40375 - DNA, 15 bp, Homo sapiens
cagcttcccccatcc

SEQ ID NO: 40376 - DNA, 15 bp, Homo sapiens
tcagcttcccccatc

SEQ ID NO: 40377 - DNA, 15 bp, Homo sapiens
ctcagcttcccccat

SEQ ID NO: 40378 - DNA, 15 bp, Homo sapiens
actcagcttccccca

SEQ ID NO: 40379 - DNA, 15 bp, Homo sapiens
cactcagcttccccc

SEQ ID NO: 40380 - DNA, 15 bp, Homo sapiens
acactcagcttcccc

SEQ ID NO: 40381 - DNA, 15 bp, Homo sapiens
cacactcagcttccc

SEQ ID NO: 40382 - DNA, 15 bp, Homo sapiens
acacactcagcttcc

SEQ ID NO: 40383 - DNA, 15 bp, Homo sapiens
cacacactcagcttc

SEQ ID NO: 40384 - DNA, 15 bp, Homo sapiens
acacacactcagctt

SEQ ID NO: 40385 - DNA, 15 bp, Homo sapiens
aacacacactcagct

SEQ ID NO: 40386 - DNA, 15 bp, Homo sapiens
taacacacactcagc

SEQ ID NO: 40387 - DNA, 15 bp, Homo sapiens
gtaacacacactcag

SEQ ID NO: 40388 - DNA, 15 bp, Homo sapiens
ggtaacacacactca

SEQ ID NO: 40389 - DNA, 15 bp, Homo sapiens
tggtaacacacactc

SEQ ID NO: 40390 - DNA, 15 bp, Homo sapiens
ctggtaacacacact

SEQ ID NO: 40391 - DNA, 15 bp, Homo sapiens
actggtaacacacac

SEQ ID NO: 40392 - DNA, 15 bp, Homo sapiens
cactggtaacacaca

SEQ ID NO: 40393 - DNA, 15 bp, Homo sapiens
ccactggtaacacac

SEQ ID NO: 40394 - DNA, 15 bp, Homo sapiens
cccactggtaacaca

SEQ ID NO: 40395 - DNA, 15 bp, Homo sapiens
ccccactggtaacac

SEQ ID NO: 40396 - DNA, 15 bp, Homo sapiens
accccactggtaaca

SEQ ID NO: 40397 - DNA, 15 bp, Homo sapiens
gaccccactggtaac

SEQ ID NO: 40398 - DNA, 15 bp, Homo sapiens
agaccccactggtaa

SEQ ID NO: 40399 - DNA, 15 bp, Homo sapiens
aagaccccactggta

SEQ ID NO: 40400 - DNA, 15 bp, Homo sapiens
taagaccccactggt

SEQ ID NO: 40401 - DNA, 15 bp, Homo sapiens
ttaagaccccactgg

SEQ ID NO: 40402 - DNA, 15 bp, Homo sapiens
tttaagaccccactg

SEQ ID NO: 40403 - DNA, 15 bp, Homo sapiens
gtttaagaccccact

SEQ ID NO: 40404 - DNA, 15 bp, Homo sapiens
tgtttaagaccccac

SEQ ID NO: 40405 - DNA, 15 bp, Homo sapiens
gtgtttaagacccca

SEQ ID NO: 40406 - DNA, 15 bp, Homo sapiens
tgtgtttaagacccc

SEQ ID NO: 40407 - DNA, 15 bp, Homo sapiens
gtgtgtttaagaccc

SEQ ID NO: 40408 - DNA, 15 bp, Homo sapiens
tgtgtgtttaagacc

SEQ ID NO: 40409 - DNA, 15 bp, Homo sapiens
ttgtgtgtttaagac

SEQ ID NO: 40410 - DNA, 15 bp, Homo sapiens
cttgtgtgtttaaga

SEQ ID NO: 40411 - DNA, 15 bp, Homo sapiens
ccttgtgtgtttaag

SEQ ID NO: 40412 - DNA, 15 bp, Homo sapiens
gccttgtgtgtttaa

SEQ ID NO: 40413 - DNA, 15 bp, Homo sapiens
ggccttgtgtgttta

SEQ ID NO: 40414 - DNA, 15 bp, Homo sapiens
aggccttgtgtgttt

SEQ ID NO: 40415 - DNA, 15 bp, Homo sapiens
gaggccttgtgtgtt

SEQ ID NO: 40416 - DNA, 15 bp, Homo sapiens
tgaggccttgtgtgt

SEQ ID NO: 40417 - DNA, 15 bp, Homo sapiens
gtgaggccttgtgtg

SEQ ID NO: 40418 - DNA, 15 bp, Homo sapiens
agtgaggccttgtgt

SEQ ID NO: 40419 - DNA, 15 bp, Homo sapiens
gagtgaggccttgtg

SEQ ID NO: 40420 - DNA, 15 bp, Homo sapiens
cgagtgaggccttgt

SEQ ID NO: 40421 - DNA, 15 bp, Homo sapiens
acgagtgaggccttg

SEQ ID NO: 40422 - DNA, 15 bp, Homo sapiens
gacgagtgaggcctt

SEQ ID NO: 40423 - DNA, 15 bp, Homo sapiens
tgacgagtgaggcct

SEQ ID NO: 40424 - DNA, 15 bp, Homo sapiens
ctgacgagtgaggcc

SEQ ID NO: 40425 - DNA, 15 bp, Homo sapiens
actgacgagtgaggc

SEQ ID NO: 40426 - DNA, 15 bp, Homo sapiens
cactgacgagtgagg

SEQ ID NO: 40427 - DNA, 15 bp, Homo sapiens
acactgacgagtgag

SEQ ID NO: 40428 - DNA, 15 bp, Homo sapiens
cacactgacgagtga

SEQ ID NO: 40429 - DNA, 15 bp, Homo sapiens
ccacactgacgagtg

SEQ ID NO: 40430 - DNA, 15 bp, Homo sapiens
accacactgacgagt

SEQ ID NO: 40431 - DNA, 15 bp, Homo sapiens
caccacactgacgag

SEQ ID NO: 40432 - DNA, 15 bp, Homo sapiens
tcaccacactgacga

SEQ ID NO: 40433 - DNA, 15 bp, Homo sapiens
ttcaccacactgacg

SEQ ID NO: 40434 - DNA, 15 bp, Homo sapiens
cttcaccacactgac

SEQ ID NO: 40435 - DNA, 15 bp, Homo sapiens
tcttcaccacactga

SEQ ID NO: 40436 - DNA, 15 bp, Homo sapiens
ttcttcaccacactg

SEQ ID NO: 40437 - DNA, 15 bp, Homo sapiens
tttcttcaccacact

SEQ ID NO: 40438 - DNA, 15 bp, Homo sapiens
ctttcttcaccacac

SEQ ID NO: 40439 - DNA, 15 bp, Homo sapiens
gctttcttcaccaca

SEQ ID NO: 40440 - DNA, 15 bp, Homo sapiens
ggctttcttcaccac

SEQ ID NO: 40441 - DNA, 15 bp, Homo sapiens
tggctttcttcacca

SEQ ID NO: 40442 - DNA, 15 bp, Homo sapiens
ttggctttcttcacc

SEQ ID NO: 40443 - DNA, 15 bp, Homo sapiens
cttggctttcttcac

SEQ ID NO: 40444 - DNA, 15 bp, Homo sapiens
tcttggctttcttca

SEQ ID NO: 40445 - DNA, 15 bp, Homo sapiens
gtcttggctttcttc

SEQ ID NO: 40446 - DNA, 15 bp, Homo sapiens
agtcttggctttctt

SEQ ID NO: 40447 - DNA, 15 bp, Homo sapiens
gagtcttggctttct

SEQ ID NO: 40448 - DNA, 15 bp, Homo sapiens
ggagtcttggctttc

SEQ ID NO: 40449 - DNA, 15 bp, Homo sapiens
cggagtcttggcttt

SEQ ID NO: 40450 - DNA, 15 bp, Homo sapiens
gcggagtcttggctt

SEQ ID NO: 40451 - DNA, 15 bp, Homo sapiens
cgcggagtcttggct

SEQ ID NO: 40452 - DNA, 15 bp, Homo sapiens
gcgcggagtcttggc

SEQ ID NO: 40453 - DNA, 15 bp, Homo sapiens
agcgcggagtcttgg

SEQ ID NO: 40454 - DNA, 15 bp, Homo sapiens
gagcgcggagtcttg

SEQ ID NO: 40455 - DNA, 15 bp, Homo sapiens
agagcgcggagtctt

SEQ ID NO: 40456 - DNA, 15 bp, Homo sapiens
gagagcgcggagtct

SEQ ID NO: 40457 - DNA, 15 bp, Homo sapiens
ggagagcgcggagtc

SEQ ID NO: 40458 - DNA, 15 bp, Homo sapiens
tggagagcgcggagt

SEQ ID NO: 40459 - DNA, 15 bp, Homo sapiens
atggagagcgcggag

SEQ ID NO: 40460 - DNA, 15 bp, Homo sapiens
aatggagagcgcgga

SEQ ID NO: 40461 - DNA, 15 bp, Homo sapiens
caatggagagcgcgg

SEQ ID NO: 40462 - DNA, 15 bp, Homo sapiens
acaatggagagcgcg

SEQ ID NO: 40463 - DNA, 15 bp, Homo sapiens
aacaatggagagcgc

SEQ ID NO: 40464 - DNA, 15 bp, Homo sapiens
taacaatggagagcg

SEQ ID NO: 40465 - DNA, 15 bp, Homo sapiens
ctaacaatggagagc

SEQ ID NO: 40466 - DNA, 15 bp, Homo sapiens
gctaacaatggagag

SEQ ID NO: 40467 - DNA, 15 bp, Homo sapiens
tgctaacaatggaga

SEQ ID NO: 40468 - DNA, 15 bp, Homo sapiens
ctgctaacaatggag

SEQ ID NO: 40469 - DNA, 15 bp, Homo sapiens
gctgctaacaatgga

SEQ ID NO: 40470 - DNA, 15 bp, Homo sapiens
ggctgctaacaatgg

SEQ ID NO: 40471 - DNA, 15 bp, Homo sapiens
aggctgctaacaatg

SEQ ID NO: 40472 - DNA, 15 bp, Homo sapiens
caggctgctaacaat

SEQ ID NO: 40473 - DNA, 15 bp, Homo sapiens
ccaggctgctaacaa

SEQ ID NO: 40474 - DNA, 15 bp, Homo sapiens
tccaggctgctaaca

SEQ ID NO: 40475 - DNA, 15 bp, Homo sapiens
ttccaggctgctaac

SEQ ID NO: 40476 - DNA, 15 bp, Homo sapiens
tttccaggctgctaa

SEQ ID NO: 40477 - DNA, 15 bp, Homo sapiens
ctttccaggctgcta

SEQ ID NO: 40478 - DNA, 15 bp, Homo sapiens
tctttccaggctgct

SEQ ID NO: 40479 - DNA, 15 bp, Homo sapiens
atctttccaggctgc

SEQ ID NO: 40480 - DNA, 15 bp, Homo sapiens
gatctttccaggctg

SEQ ID NO: 40481 - DNA, 15 bp, Homo sapiens
agatctttccaggct

SEQ ID NO: 40482 - DNA, 15 bp, Homo sapiens
cagatctttccaggc

SEQ ID NO: 40483 - DNA, 15 bp, Homo sapiens
ccagatctttccagg

SEQ ID NO: 40484 - DNA, 15 bp, Homo sapiens
tccagatctttccag

SEQ ID NO: 40485 - DNA, 15 bp, Homo sapiens
ctccagatctttcca

SEQ ID NO: 40486 - DNA, 15 bp, Homo sapiens
tctccagatctttcc

SEQ ID NO: 40487 - DNA, 15 bp, Homo sapiens
gtctccagatctttc

SEQ ID NO: 40488 - DNA, 15 bp, Homo sapiens
agtctccagatcttt

SEQ ID NO: 40489 - DNA, 15 bp, Homo sapiens
tagtctccagatctt

SEQ ID NO: 40490 - DNA, 15 bp, Homo sapiens
ctagtctccagatct

SEQ ID NO: 40491 - DNA, 15 bp, Homo sapiens
gctagtctccagatc

SEQ ID NO: 40492 - DNA, 15 bp, Homo sapiens
tgctagtctccagat

SEQ ID NO: 40493 - DNA, 15 bp, Homo sapiens
ttgctagtctccaga

SEQ ID NO: 40494 - DNA, 15 bp, Homo sapiens
attgctagtctccag

SEQ ID NO: 40495 - DNA, 15 bp, Homo sapiens
cattgctagtctcca

SEQ ID NO: 40496 - DNA, 15 bp, Homo sapiens
ccattgctagtctcc

SEQ ID NO: 40497 - DNA, 15 bp, Homo sapiens
tccattgctagtctc

SEQ ID NO: 40498 - DNA, 15 bp, Homo sapiens
ctccattgctagtct

SEQ ID NO: 40499 - DNA, 15 bp, Homo sapiens
tctccattgctagtc

SEQ ID NO: 40500 - DNA, 15 bp, Homo sapiens
ctctccattgctagt

SEQ ID NO: 40501 - DNA, 15 bp, Homo sapiens
tctctccattgctag

SEQ ID NO: 40502 - DNA, 15 bp, Homo sapiens
atctctccattgcta

SEQ ID NO: 40503 - DNA, 15 bp, Homo sapiens
catctctccattgct

SEQ ID NO: 40504 - DNA, 15 bp, Homo sapiens
acatctctccattgc

SEQ ID NO: 40505 - DNA, 15 bp, Homo sapiens
aacatctctccattg

SEQ ID NO: 40506 - DNA, 15 bp, Homo sapiens
aaacatctctccatt

SEQ ID NO: 40507 - DNA, 15 bp, Homo sapiens
gaaacatctctccat

SEQ ID NO: 40508 - DNA, 15 bp, Homo sapiens
agaaacatctctcca

SEQ ID NO: 40509 - DNA, 15 bp, Homo sapiens
aagaaacatctctcc

SEQ ID NO: 40510 - DNA, 15 bp, Homo sapiens
taagaaacatctctc

SEQ ID NO: 40511 - DNA, 15 bp, Homo sapiens
ctaagaaacatctct

SEQ ID NO: 40512 - DNA, 15 bp, Homo sapiens
cctaagaaacatctc

SEQ ID NO: 40513 - DNA, 15 bp, Homo sapiens
gcctaagaaacatct

SEQ ID NO: 40514 - DNA, 15 bp, Homo sapiens
agcctaagaaacatc

SEQ ID NO: 40515 - DNA, 15 bp, Homo sapiens
cagcctaagaaacat

SEQ ID NO: 40516 - DNA, 15 bp, Homo sapiens
acagcctaagaaaca

SEQ ID NO: 40517 - DNA, 15 bp, Homo sapiens
aacagcctaagaaac

SEQ ID NO: 40518 - DNA, 15 bp, Homo sapiens
gaacagcctaagaaa

SEQ ID NO: 40519 - DNA, 15 bp, Homo sapiens
tgaacagcctaagaa

SEQ ID NO: 40520 - DNA, 15 bp, Homo sapiens
ctgaacagcctaaga

SEQ ID NO: 40521 - DNA, 15 bp, Homo sapiens
tctgaacagcctaag

SEQ ID NO: 40522 - DNA, 15 bp, Homo sapiens
atctgaacagcctaa

SEQ ID NO: 40523 - DNA, 15 bp, Homo sapiens
gatctgaacagccta

SEQ ID NO: 40524 - DNA, 15 bp, Homo sapiens
ggatctgaacagcct

SEQ ID NO: 40525 - DNA, 15 bp, Homo sapiens
tggatctgaacagcc

SEQ ID NO: 40526 - DNA, 15 bp, Homo sapiens
ttggatctgaacagc

SEQ ID NO: 40527 - DNA, 15 bp, Homo sapiens
tttggatctgaacag

SEQ ID NO: 40528 - DNA, 15 bp, Homo sapiens
ttttggatctgaaca

SEQ ID NO: 40529 - DNA, 15 bp, Homo sapiens
gttttggatctgaac

SEQ ID NO: 40530 - DNA, 15 bp, Homo sapiens
agttttggatctgaa

SEQ ID NO: 40531 - DNA, 15 bp, Homo sapiens
aagttttggatctga

SEQ ID NO: 40532 - DNA, 15 bp, Homo sapiens
gaagttttggatctg

SEQ ID NO: 40533 - DNA, 15 bp, Homo sapiens
ggaagttttggatct

SEQ ID NO: 40534 - DNA, 15 bp, Homo sapiens
tggaagttttggatc

SEQ ID NO: 40535 - DNA, 15 bp, Homo sapiens
gtggaagttttggat

SEQ ID NO: 40536 - DNA, 15 bp, Homo sapiens
tgtggaagttttgga

SEQ ID NO: 40537 - DNA, 15 bp, Homo sapiens
atgtggaagttttgg

SEQ ID NO: 40538 - DNA, 15 bp, Homo sapiens
aatgtggaagttttg

SEQ ID NO: 40539 - DNA, 15 bp, Homo sapiens
gaatgtggaagtttt

SEQ ID NO: 40540 - DNA, 15 bp, Homo sapiens
ggaatgtggaagttt

SEQ ID NO: 40541 - DNA, 15 bp, Homo sapiens
gggaatgtggaagtt

SEQ ID NO: 40542 - DNA, 15 bp, Homo sapiens
ggggaatgtggaagt

SEQ ID NO: 40543 - DNA, 15 bp, Homo sapiens
cggggaatgtggaag

SEQ ID NO: 40544 - DNA, 15 bp, Homo sapiens
acggggaatgtggaa

SEQ ID NO: 40545 - DNA, 15 bp, Homo sapiens
aacggggaatgtgga

SEQ ID NO: 40546 - DNA, 15 bp, Homo sapiens
caacggggaatgtgg

SEQ ID NO: 40547 - DNA, 15 bp, Homo sapiens
acaacggggaatgtg

SEQ ID NO: 40548 - DNA, 15 bp, Homo sapiens
aacaacggggaatgt

SEQ ID NO: 40549 - DNA, 15 bp, Homo sapiens
caacaacggggaatg

SEQ ID NO: 40550 - DNA, 15 bp, Homo sapiens
tcaacaacggggaat

SEQ ID NO: 40551 - DNA, 15 bp, Homo sapiens
atcaacaacggggaa

SEQ ID NO: 40552 - DNA, 15 bp, Homo sapiens
tatcaacaacgggga

SEQ ID NO: 40553 - DNA, 15 bp, Homo sapiens
ctatcaacaacgggg

SEQ ID NO: 40554 - DNA, 15 bp, Homo sapiens
cctatcaacaacggg

SEQ ID NO: 40555 - DNA, 15 bp, Homo sapiens
acctatcaacaacgg

SEQ ID NO: 40556 - DNA, 15 bp, Homo sapiens
tacctatcaacaacg

SEQ ID NO: 40557 - DNA, 15 bp, Homo sapiens
atacctatcaacaac

SEQ ID NO: 40558 - DNA, 15 bp, Homo sapiens
catacctatcaacaa

SEQ ID NO: 40559 - DNA, 15 bp, Homo sapiens
ccatacctatcaaca

SEQ ID NO: 40560 - DNA, 15 bp, Homo sapiens
cccatacctatcaac

SEQ ID NO: 40561 - DNA, 15 bp, Homo sapiens
tcccatacctatcaa

SEQ ID NO: 40562 - DNA, 15 bp, Homo sapiens
atcccatacctatca

SEQ ID NO: 40563 - DNA, 15 bp, Homo sapiens
catcccatacctatc

SEQ ID NO: 40564 - DNA, 15 bp, Homo sapiens
ccatcccatacctat

SEQ ID NO: 40565 - DNA, 15 bp, Homo sapiens
tccatcccataccta

SEQ ID NO: 40566 - DNA, 15 bp, Homo sapiens
ctccatcccatacct

SEQ ID NO: 40567 - DNA, 15 bp, Homo sapiens
tctccatcccatacc

SEQ ID NO: 40568 - DNA, 15 bp, Homo sapiens
ctctccatcccatac

SEQ ID NO: 40569 - DNA, 15 bp, Homo sapiens
cctctccatcccata

SEQ ID NO: 40570 - DNA, 15 bp, Homo sapiens
acctctccatcccat

SEQ ID NO: 40571 - DNA, 15 bp, Homo sapiens
cacctctccatccca

SEQ ID NO: 40572 - DNA, 15 bp, Homo sapiens
tcacctctccatccc

SEQ ID NO: 40573 - DNA, 15 bp, Homo sapiens
ttcacctctccatcc

SEQ ID NO: 40574 - DNA, 15 bp, Homo sapiens
gttcacctctccatc

SEQ ID NO: 40575 - DNA, 15 bp, Homo sapiens
tgttcacctctccat

SEQ ID NO: 40576 - DNA, 15 bp, Homo sapiens
ctgttcacctctcca

SEQ ID NO: 40577 - DNA, 15 bp, Homo sapiens
tctgttcacctctcc

SEQ ID NO: 40578 - DNA, 15 bp, Homo sapiens
ttctgttcacctctc

SEQ ID NO: 40579 - DNA, 15 bp, Homo sapiens
gttctgttcacctct

SEQ ID NO: 40580 - DNA, 15 bp, Homo sapiens
agttctgttcacctc

SEQ ID NO: 40581 - DNA, 15 bp, Homo sapiens
cagttctgttcacct

SEQ ID NO: 40582 - DNA, 15 bp, Homo sapiens
tcagttctgttcacc

SEQ ID NO: 40583 - DNA, 15 bp, Homo sapiens
ttcagttctgttcac

SEQ ID NO: 40584 - DNA, 15 bp, Homo sapiens
cttcagttctgttca

SEQ ID NO: 40585 - DNA, 15 bp, Homo sapiens
gcttcagttctgttc

SEQ ID NO: 40586 - DNA, 15 bp, Homo sapiens
tgcttcagttctgtt

SEQ ID NO: 40587 - DNA, 15 bp, Homo sapiens
ctgcttcagttctgt

SEQ ID NO: 40588 - DNA, 15 bp, Homo sapiens
gctgcttcagttctg

SEQ ID NO: 40589 - DNA, 15 bp, Homo sapiens
agctgcttcagttct

SEQ ID NO: 40590 - DNA, 15 bp, Homo sapiens
cagctgcttcagttc

SEQ ID NO: 40591 - DNA, 15 bp, Homo sapiens
acagctgcttcagtt

SEQ ID NO: 40592 - DNA, 15 bp, Homo sapiens
aacagctgcttcagt

SEQ ID NO: 40593 - DNA, 15 bp, Homo sapiens
caacagctgcttcag

SEQ ID NO: 40594 - DNA, 15 bp, Homo sapiens
ccaacagctgcttca

SEQ ID NO: 40595 - DNA, 15 bp, Homo sapiens
tccaacagctgcttc

SEQ ID NO: 40596 - DNA, 15 bp, Homo sapiens
ttccaacagctgctt

SEQ ID NO: 40597 - DNA, 15 bp, Homo sapiens
attccaacagctgct

SEQ ID NO: 40598 - DNA, 15 bp, Homo sapiens
aattccaacagctgc

SEQ ID NO: 40599 - DNA, 15 bp, Homo sapiens
gaattccaacagctg

SEQ ID NO: 40600 - DNA, 15 bp, Homo sapiens
tgaattccaacagct

SEQ ID NO: 40601 - DNA, 15 bp, Homo sapiens
atgaattccaacagc

SEQ ID NO: 40602 - DNA, 15 bp, Homo sapiens
aatgaattccaacag

SEQ ID NO: 40603 - DNA, 15 bp, Homo sapiens
aaatgaattccaaca

SEQ ID NO: 40604 - DNA, 15 bp, Homo sapiens
caaatgaattccaac

SEQ ID NO: 40605 - DNA, 15 bp, Homo sapiens
gcaaatgaattccaa

SEQ ID NO: 40606 - DNA, 15 bp, Homo sapiens
agcaaatgaattcca

SEQ ID NO: 40607 - DNA, 15 bp, Homo sapiens
cagcaaatgaattcc

SEQ ID NO: 40608 - DNA, 15 bp, Homo sapiens
ccagcaaatgaattc

SEQ ID NO: 40609 - DNA, 15 bp, Homo sapiens
accagcaaatgaatt

SEQ ID NO: 40610 - DNA, 15 bp, Homo sapiens
aaccagcaaatgaat

SEQ ID NO: 40611 - DNA, 15 bp, Homo sapiens
taaccagcaaatgaa

SEQ ID NO: 40612 - DNA, 15 bp, Homo sapiens
gtaaccagcaaatga

SEQ ID NO: 40613 - DNA, 15 bp, Homo sapiens
agtaaccagcaaatg

SEQ ID NO: 40614 - DNA, 15 bp, Homo sapiens
aagtaaccagcaaat

SEQ ID NO: 40615 - DNA, 15 bp, Homo sapiens
aaagtaaccagcaaa

SEQ ID NO: 40616 - DNA, 15 bp, Homo sapiens
taaagtaaccagcaa

SEQ ID NO: 40617 - DNA, 15 bp, Homo sapiens
ctaaagtaaccagca

SEQ ID NO: 40618 - DNA, 15 bp, Homo sapiens
actaaagtaaccagc

SEQ ID NO: 40619 - DNA, 15 bp, Homo sapiens
cactaaagtaaccag

SEQ ID NO: 40620 - DNA, 15 bp, Homo sapiens
gcactaaagtaacca

SEQ ID NO: 40621 - DNA, 15 bp, Homo sapiens
agcactaaagtaacc

SEQ ID NO: 40622 - DNA, 15 bp, Homo sapiens
aagcactaaagtaac

SEQ ID NO: 40623 - DNA, 15 bp, Homo sapiens
taagcactaaagtaa

SEQ ID NO: 40624 - DNA, 15 bp, Homo sapiens
ataagcactaaagta

SEQ ID NO: 40625 - DNA, 15 bp, Homo sapiens
aataagcactaaagt

SEQ ID NO: 40626 - DNA, 15 bp, Homo sapiens
aaataagcactaaag

SEQ ID NO: 40627 - DNA, 15 bp, Homo sapiens
caaataagcactaaa

SEQ ID NO: 40628 - DNA, 15 bp, Homo sapiens
ccaaataagcactaa

SEQ ID NO: 40629 - DNA, 15 bp, Homo sapiens
gccaaataagcacta

SEQ ID NO: 40630 - DNA, 15 bp, Homo sapiens
tgccaaataagcact

SEQ ID NO: 40631 - DNA, 15 bp, Homo sapiens
ctgccaaataagcac

SEQ ID NO: 40632 - DNA, 15 bp, Homo sapiens
actgccaaataagca

SEQ ID NO: 40633 - DNA, 15 bp, Homo sapiens
cactgccaaataagc

SEQ ID NO: 40634 - DNA, 15 bp, Homo sapiens
tcactgccaaataag

SEQ ID NO: 40635 - DNA, 15 bp, Homo sapiens
atcactgccaaataa

SEQ ID NO: 40636 - DNA, 15 bp, Homo sapiens
catcactgccaaata

SEQ ID NO: 40637 - DNA, 15 bp, Homo sapiens
ccatcactgccaaat

SEQ ID NO: 40638 - DNA, 15 bp, Homo sapiens
cccatcactgccaaa

SEQ ID NO: 40639 - DNA, 15 bp, Homo sapiens
acccatcactgccaa

SEQ ID NO: 40640 - DNA, 15 bp, Homo sapiens
aacccatcactgcca

SEQ ID NO: 40641 - DNA, 15 bp, Homo sapiens
aaacccatcactgcc

SEQ ID NO: 40642 - DNA, 15 bp, Homo sapiens
caaacccatcactgc

SEQ ID NO: 40643 - DNA, 15 bp, Homo sapiens
ccaaacccatcactg

SEQ ID NO: 40644 - DNA, 15 bp, Homo sapiens
cccaaacccatcact

SEQ ID NO: 40645 - DNA, 15 bp, Homo sapiens
tcccaaacccatcac

SEQ ID NO: 40646 - DNA, 15 bp, Homo sapiens
atcccaaacccatca

SEQ ID NO: 40647 - DNA, 15 bp, Homo sapiens
aatcccaaacccatc

SEQ ID NO: 40648 - DNA, 15 bp, Homo sapiens
caatcccaaacccat

SEQ ID NO: 40649 - DNA, 15 bp, Homo sapiens
ccaatcccaaaccca

SEQ ID NO: 40650 - DNA, 15 bp, Homo sapiens
cccaatcccaaaccc

SEQ ID NO: 40651 - DNA, 15 bp, Homo sapiens
acccaatcccaaacc

SEQ ID NO: 40652 - DNA, 15 bp, Homo sapiens
aacccaatcccaaac

SEQ ID NO: 40653 - DNA, 15 bp, Homo sapiens
aaacccaatcccaaa

SEQ ID NO: 40654 - DNA, 15 bp, Homo sapiens
aaaacccaatcccaa

SEQ ID NO: 40655 - DNA, 15 bp, Homo sapiens
aaaaacccaatccca

SEQ ID NO: 40656 - DNA, 15 bp, Homo sapiens
caaaaacccaatccc

SEQ ID NO: 40657 - DNA, 15 bp, Homo sapiens
ccaaaaacccaatcc

SEQ ID NO: 40658 - DNA, 15 bp, Homo sapiens
accaaaaacccaatc

SEQ ID NO: 40659 - DNA, 15 bp, Homo sapiens
aaccaaaaacccaat

SEQ ID NO: 40660 - DNA, 15 bp, Homo sapiens
aaaccaaaaacccaa

SEQ ID NO: 40661 - DNA, 15 bp, Homo sapiens
aaaaccaaaaaccca

SEQ ID NO: 40662 - DNA, 15 bp, Homo sapiens
caaaaccaaaaaccc

SEQ ID NO: 40663 - DNA, 15 bp, Homo sapiens
gcaaaaccaaaaacc

SEQ ID NO: 40664 - DNA, 15 bp, Homo sapiens
tgcaaaaccaaaaac

SEQ ID NO: 40665 - DNA, 15 bp, Homo sapiens
gtgcaaaaccaaaaa

SEQ ID NO: 40666 - DNA, 15 bp, Homo sapiens
tgtgcaaaaccaaaa

SEQ ID NO: 40667 - DNA, 15 bp, Homo sapiens
atgtgcaaaaccaaa

SEQ ID NO: 40668 - DNA, 15 bp, Homo sapiens
aatgtgcaaaaccaa

SEQ ID NO: 40669 - DNA, 15 bp, Homo sapiens
gaatgtgcaaaacca

SEQ ID NO: 40670 - DNA, 15 bp, Homo sapiens
ggaatgtgcaaaacc

SEQ ID NO: 40671 - DNA, 15 bp, Homo sapiens
gggaatgtgcaaaac

SEQ ID NO: 40672 - DNA, 15 bp, Homo sapiens
agggaatgtgcaaaa

SEQ ID NO: 40673 - DNA, 15 bp, Homo sapiens
tagggaatgtgcaaa

SEQ ID NO: 40674 - DNA, 15 bp, Homo sapiens
ttagggaatgtgcaa

SEQ ID NO: 40675 - DNA, 15 bp, Homo sapiens
cttagggaatgtgca

SEQ ID NO: 40676 - DNA, 15 bp, Homo sapiens
tcttagggaatgtgc

SEQ ID NO: 40677 - DNA, 15 bp, Homo sapiens
atcttagggaatgtg

SEQ ID NO: 40678 - DNA, 15 bp, Homo sapiens
catcttagggaatgt

SEQ ID NO: 40679 - DNA, 15 bp, Homo sapiens
tcatcttagggaatg

SEQ ID NO: 40680 - DNA, 15 bp, Homo sapiens
atcatcttagggaat

SEQ ID NO: 40681 - DNA, 15 bp, Homo sapiens
aatcatcttagggaa

SEQ ID NO: 40682 - DNA, 15 bp, Homo sapiens
gaatcatcttaggga

SEQ ID NO: 40683 - DNA, 15 bp, Homo sapiens
agaatcatcttaggg

SEQ ID NO: 40684 - DNA, 15 bp, Homo sapiens
aagaatcatcttagg

SEQ ID NO: 40685 - DNA, 15 bp, Homo sapiens
aaagaatcatcttag

SEQ ID NO: 40686 - DNA, 15 bp, Homo sapiens
taaagaatcatctta

SEQ ID NO: 40687 - DNA, 15 bp, Homo sapiens
ataaagaatcatctt

SEQ ID NO: 40688 - DNA, 15 bp, Homo sapiens
gataaagaatcatct

SEQ ID NO: 40689 - DNA, 15 bp, Homo sapiens
tgataaagaatcatc

SEQ ID NO: 40690 - DNA, 15 bp, Homo sapiens
gtgataaagaatcat

SEQ ID NO: 40691 - DNA, 15 bp, Homo sapiens
agtgataaagaatca

SEQ ID NO: 40692 - DNA, 15 bp, Homo sapiens
aagtgataaagaatc

SEQ ID NO: 40693 - DNA, 15 bp, Homo sapiens
aaagtgataaagaat

SEQ ID NO: 40694 - DNA, 15 bp, Homo sapiens
taaagtgataaagaa

SEQ ID NO: 40695 - DNA, 15 bp, Homo sapiens
ttaaagtgataaaga

SEQ ID NO: 40696 - DNA, 15 bp, Homo sapiens
tttaaagtgataaag

SEQ ID NO: 40697 - DNA, 15 bp, Homo sapiens
ttttaaagtgataaa

SEQ ID NO: 40698 - DNA, 15 bp, Homo sapiens
tttttaaagtgataa

SEQ ID NO: 40699 - DNA, 15 bp, Homo sapiens
ttttttaaagtgata

SEQ ID NO: 40700 - DNA, 15 bp, Homo sapiens
attttttaaagtgat

SEQ ID NO: 40701 - DNA, 15 bp, Homo sapiens
tattttttaaagtga

SEQ ID NO: 40702 - DNA, 15 bp, Homo sapiens
gtattttttaaagtg

SEQ ID NO: 40703 - DNA, 15 bp, Homo sapiens
ggtattttttaaagt

SEQ ID NO: 40704 - DNA, 15 bp, Homo sapiens
tggtattttttaaag

SEQ ID NO: 40705 - DNA, 15 bp, Homo sapiens
ctggtattttttaaa

SEQ ID NO: 40706 - DNA, 15 bp, Homo sapiens
cctggtattttttaa

SEQ ID NO: 40707 - DNA, 15 bp, Homo sapiens
tcctggtatttttta

SEQ ID NO: 40708 - DNA, 15 bp, Homo sapiens
atcctggtatttttt

SEQ ID NO: 40709 - DNA, 15 bp, Homo sapiens
tatcctggtattttt

SEQ ID NO: 40710 - DNA, 15 bp, Homo sapiens
gtatcctggtatttt

SEQ ID NO: 40711 - DNA, 15 bp, Homo sapiens
tgtatcctggtattt

SEQ ID NO: 40712 - DNA, 15 bp, Homo sapiens
ttgtatcctggtatt

SEQ ID NO: 40713 - DNA, 15 bp, Homo sapiens
cttgtatcctggtat

SEQ ID NO: 40714 - DNA, 15 bp, Homo sapiens
ccttgtatcctggta

SEQ ID NO: 40715 - DNA, 15 bp, Homo sapiens
tccttgtatcctggt

SEQ ID NO: 40716 - DNA, 15 bp, Homo sapiens
atccttgtatcctgg

SEQ ID NO: 40717 - DNA, 15 bp, Homo sapiens
tatccttgtatcctg

SEQ ID NO: 40718 - DNA, 15 bp, Homo sapiens
ctatccttgtatcct

SEQ ID NO: 40719 - DNA, 15 bp, Homo sapiens
gctatccttgtatcc

SEQ ID NO: 40720 - DNA, 15 bp, Homo sapiens
agctatccttgtatc

SEQ ID NO: 40721 - DNA, 15 bp, Homo sapiens
cagctatccttgtat

SEQ ID NO: 40722 - DNA, 15 bp, Homo sapiens
ccagctatccttgta

SEQ ID NO: 40723 - DNA, 15 bp, Homo sapiens
tccagctatccttgt

SEQ ID NO: 40724 - DNA, 15 bp, Homo sapiens
atccagctatccttg

SEQ ID NO: 40725 - DNA, 15 bp, Homo sapiens
catccagctatcctt

SEQ ID NO: 40726 - DNA, 15 bp, Homo sapiens
tcatccagctatcct

SEQ ID NO: 40727 - DNA, 15 bp, Homo sapiens
atcatccagctatcc

SEQ ID NO: 40728 - DNA, 15 bp, Homo sapiens
aatcatccagctatc

SEQ ID NO: 40729 - DNA, 15 bp, Homo sapiens
gaatcatccagctat

SEQ ID NO: 40730 - DNA, 15 bp, Homo sapiens
agaatcatccagcta

SEQ ID NO: 40731 - DNA, 15 bp, Homo sapiens
tagaatcatccagct

SEQ ID NO: 40732 - DNA, 15 bp, Homo sapiens
atagaatcatccagc

SEQ ID NO: 40733 - DNA, 15 bp, Homo sapiens
tatagaatcatccag

SEQ ID NO: 40734 - DNA, 15 bp, Homo sapiens
ttatagaatcatcca

SEQ ID NO: 40735 - DNA, 15 bp, Homo sapiens
tttatagaatcatcc

SEQ ID NO: 40736 - DNA, 15 bp, Homo sapiens
atttatagaatcatc

SEQ ID NO: 40737 - DNA, 15 bp, Homo sapiens
gatttatagaatcat

SEQ ID NO: 40738 - DNA, 15 bp, Homo sapiens
agatttatagaatca

SEQ ID NO: 40739 - DNA, 15 bp, Homo sapiens
tagatttatagaatc

SEQ ID NO: 40740 - DNA, 15 bp, Homo sapiens
ttagatttatagaat

SEQ ID NO: 40741 - DNA, 15 bp, Homo sapiens
attagatttatagaa

SEQ ID NO: 40742 - DNA, 15 bp, Homo sapiens
aattagatttataga

SEQ ID NO: 40743 - DNA, 15 bp, Homo sapiens
aaattagatttatag

SEQ ID NO: 40744 - DNA, 15 bp, Homo sapiens
aaaattagatttata

SEQ ID NO: 40745 - DNA, 15 bp, Homo sapiens
aaaaattagatttat

SEQ ID NO: 40746 - DNA, 15 bp, Homo sapiens
taaaaattagattta

SEQ ID NO: 40747 - DNA, 15 bp, Homo sapiens
ttaaaaattagattt

SEQ ID NO: 40748 - DNA, 15 bp, Homo sapiens
tttaaaaattagatt

SEQ ID NO: 40749 - DNA, 15 bp, Homo sapiens
ttttaaaaattagat

SEQ ID NO: 40750 - DNA, 15 bp, Homo sapiens
gttttaaaaattaga

SEQ ID NO: 40751 - DNA, 15 bp, Homo sapiens
agttttaaaaattag

SEQ ID NO: 40752 - DNA, 15 bp, Homo sapiens
tagttttaaaaatta

SEQ ID NO: 40753 - DNA, 15 bp, Homo sapiens
atagttttaaaaatt

SEQ ID NO: 40754 - DNA, 15 bp, Homo sapiens
gatagttttaaaaat

SEQ ID NO: 40755 - DNA, 15 bp, Homo sapiens
tgatagttttaaaaa

SEQ ID NO: 40756 - DNA, 15 bp, Homo sapiens
ctgatagttttaaaa

SEQ ID NO: 40757 - DNA, 15 bp, Homo sapiens
actgatagttttaaa

SEQ ID NO: 40758 - DNA, 15 bp, Homo sapiens
aactgatagttttaa

SEQ ID NO: 40759 - DNA, 15 bp, Homo sapiens
gaactgatagtttta

SEQ ID NO: 40760 - DNA, 15 bp, Homo sapiens
agaactgatagtttt

SEQ ID NO: 40761 - DNA, 15 bp, Homo sapiens
cagaactgatagttt

SEQ ID NO: 40762 - DNA, 15 bp, Homo sapiens
ccagaactgatagtt

SEQ ID NO: 40763 - DNA, 15 bp, Homo sapiens
cccagaactgatagt

SEQ ID NO: 40764 - DNA, 15 bp, Homo sapiens
acccagaactgatag

SEQ ID NO: 40765 - DNA, 15 bp, Homo sapiens
tacccagaactgata

SEQ ID NO: 40766 - DNA, 15 bp, Homo sapiens
ctacccagaactgat

SEQ ID NO: 40767 - DNA, 15 bp, Homo sapiens
cctacccagaactga

SEQ ID NO: 40768 - DNA, 15 bp, Homo sapiens
gcctacccagaactg

SEQ ID NO: 40769 - DNA, 15 bp, Homo sapiens
tgcctacccagaact

SEQ ID NO: 40770 - DNA, 15 bp, Homo sapiens
gtgcctacccagaac

SEQ ID NO: 40771 - DNA, 15 bp, Homo sapiens
cgtgcctacccagaa

SEQ ID NO: 40772 - DNA, 15 bp, Homo sapiens
ccgtgcctacccaga

SEQ ID NO: 40773 - DNA, 15 bp, Homo sapiens
accgtgcctacccag

SEQ ID NO: 40774 - DNA, 15 bp, Homo sapiens
caccgtgcctaccca

SEQ ID NO: 40775 - DNA, 15 bp, Homo sapiens
ccaccgtgcctaccc

SEQ ID NO: 40776 - DNA, 15 bp, Homo sapiens
gccaccgtgcctacc

SEQ ID NO: 40777 - DNA, 15 bp, Homo sapiens
agccaccgtgcctac

SEQ ID NO: 40778 - DNA, 15 bp, Homo sapiens
gagccaccgtgccta

SEQ ID NO: 40779 - DNA, 15 bp, Homo sapiens
ggcgtgagccaccgt

SEQ ID NO: 40780 - DNA, 15 bp, Homo sapiens
gcaggcgtgagccac

SEQ ID NO: 40781 - DNA, 15 bp, Homo sapiens
tgcaggcgtgagcca

SEQ ID NO: 40782 - DNA, 15 bp, Homo sapiens
ttgcaggcgtgagcc

SEQ ID NO: 40783 - DNA, 15 bp, Homo sapiens
attgcaggcgtgagc

SEQ ID NO: 40784 - DNA, 15 bp, Homo sapiens
gattgcaggcgtgag

SEQ ID NO: 40785 - DNA, 15 bp, Homo sapiens
ggattgcaggcgtga

SEQ ID NO: 40786 - DNA, 15 bp, Homo sapiens
gggattgcaggcgtg

SEQ ID NO: 40787 - DNA, 15 bp, Homo sapiens
tgggattgcaggcgt

SEQ ID NO: 40788 - DNA, 15 bp, Homo sapiens
ctgggattgcaggcg

SEQ ID NO: 40789 - DNA, 15 bp, Homo sapiens
gctgggattgcaggc

SEQ ID NO: 40790 - DNA, 15 bp, Homo sapiens
tgctgggattgcagg

SEQ ID NO: 40791 - DNA, 15 bp, Homo sapiens
gtgctgggattgcag

SEQ ID NO: 40792 - DNA, 15 bp, Homo sapiens
agtgctgggattgca

SEQ ID NO: 40793 - DNA, 15 bp, Homo sapiens
aagtgctgggattgc

SEQ ID NO: 40794 - DNA, 15 bp, Homo sapiens
aaagtgctgggattg

SEQ ID NO: 40795 - DNA, 15 bp, Homo sapiens
tgtgatctgcctgcc

SEQ ID NO: 40796 - DNA, 15 bp, Homo sapiens
ttgtgatctgcctgc

SEQ ID NO: 40797 - DNA, 15 bp, Homo sapiens
cttgtgatctgcctg

SEQ ID NO: 40798 - DNA, 15 bp, Homo sapiens
ccttgtgatctgcct

SEQ ID NO: 40799 - DNA, 15 bp, Homo sapiens
accttgtgatctgcc

SEQ ID NO: 40800 - DNA, 15 bp, Homo sapiens
taccttgtgatctgc

SEQ ID NO: 40801 - DNA, 15 bp, Homo sapiens
ctaccttgtgatctg

SEQ ID NO: 40802 - DNA, 15 bp, Homo sapiens
cctaccttgtgatct

SEQ ID NO: 40803 - DNA, 15 bp, Homo sapiens
tcctaccttgtgatc

SEQ ID NO: 40804 - DNA, 15 bp, Homo sapiens
ctcctaccttgtgat

SEQ ID NO: 40805 - DNA, 15 bp, Homo sapiens
tctcctaccttgtga

SEQ ID NO: 40806 - DNA, 15 bp, Homo sapiens
atctcctaccttgtg

SEQ ID NO: 40807 - DNA, 15 bp, Homo sapiens
gatctcctaccttgt

SEQ ID NO: 40808 - DNA, 15 bp, Homo sapiens
cgatctcctaccttg

SEQ ID NO: 40809 - DNA, 15 bp, Homo sapiens
tcgatctcctacctt

SEQ ID NO: 40810 - DNA, 15 bp, Homo sapiens
ctcgatctcctacct

SEQ ID NO: 40811 - DNA, 15 bp, Homo sapiens
tctcgatctcctacc

SEQ ID NO: 40812 - DNA, 15 bp, Homo sapiens
gtctcgatctcctac

SEQ ID NO: 40813 - DNA, 15 bp, Homo sapiens
ggtctcgatctccta

SEQ ID NO: 40814 - DNA, 15 bp, Homo sapiens
tggtctcgatctcct

SEQ ID NO: 40815 - DNA, 15 bp, Homo sapiens
atggtctcgatctcc

SEQ ID NO: 40816 - DNA, 15 bp, Homo sapiens
gatggtctcgatctc

SEQ ID NO: 40817 - DNA, 15 bp, Homo sapiens
ggatggtctcgatct

SEQ ID NO: 40818 - DNA, 15 bp, Homo sapiens
aggatggtctcgatc

SEQ ID NO: 40819 - DNA, 15 bp, Homo sapiens
caggatggtctcgat

SEQ ID NO: 40820 - DNA, 15 bp, Homo sapiens
ccaggatggtctcga

SEQ ID NO: 40821 - DNA, 15 bp, Homo sapiens
gccaggatggtctcg

SEQ ID NO: 40822 - DNA, 15 bp, Homo sapiens
agccaggatggtctc

SEQ ID NO: 40823 - DNA, 15 bp, Homo sapiens
tagccaggatggtct

SEQ ID NO: 40824 - DNA, 15 bp, Homo sapiens
ttagccaggatggtc

SEQ ID NO: 40825 - DNA, 15 bp, Homo sapiens
gttagccaggatggt

SEQ ID NO: 40826 - DNA, 15 bp, Homo sapiens
tgttagccaggatgg

SEQ ID NO: 40827 - DNA, 15 bp, Homo sapiens
gtgttagccaggatg

SEQ ID NO: 40828 - DNA, 15 bp, Homo sapiens
cgtgttagccaggat

SEQ ID NO: 40829 - DNA, 15 bp, Homo sapiens
tcgtgttagccagga

SEQ ID NO: 40830 - DNA, 15 bp, Homo sapiens
atcgtgttagccagg

SEQ ID NO: 40831 - DNA, 15 bp, Homo sapiens
catcgtgttagccag

SEQ ID NO: 40832 - DNA, 15 bp, Homo sapiens
tcatcgtgttagcca

SEQ ID NO: 40833 - DNA, 15 bp, Homo sapiens
ttcatcgtgttagcc

SEQ ID NO: 40834 - DNA, 15 bp, Homo sapiens
tttcatcgtgttagc

SEQ ID NO: 40835 - DNA, 15 bp, Homo sapiens
gtttcatcgtgttag

SEQ ID NO: 40836 - DNA, 15 bp, Homo sapiens
ggtttcatcgtgtta

SEQ ID NO: 40837 - DNA, 15 bp, Homo sapiens
gggtttcatcgtgtt

SEQ ID NO: 40838 - DNA, 15 bp, Homo sapiens
ggggtttcatcgtgt

SEQ ID NO: 40839 - DNA, 15 bp, Homo sapiens
cggggtttcatcgtg

SEQ ID NO: 40840 - DNA, 15 bp, Homo sapiens
acggggtttcatcgt

SEQ ID NO: 40841 - DNA, 15 bp, Homo sapiens
gacggggtttcatcg

SEQ ID NO: 40842 - DNA, 15 bp, Homo sapiens
agacggggtttcatc

SEQ ID NO: 40843 - DNA, 15 bp, Homo sapiens
gagacggggtttcat

SEQ ID NO: 40844 - DNA, 15 bp, Homo sapiens
ttttttagtagagac

SEQ ID NO: 40845 - DNA, 15 bp, Homo sapiens
tttttttagtagaga

SEQ ID NO: 40846 - DNA, 15 bp, Homo sapiens
ttttttttagtagag

SEQ ID NO: 40847 - DNA, 15 bp, Homo sapiens
attttttttagtaga

SEQ ID NO: 40848 - DNA, 15 bp, Homo sapiens
aattttttttagtag

SEQ ID NO: 40849 - DNA, 15 bp, Homo sapiens
caattttttttagta

SEQ ID NO: 40850 - DNA, 15 bp, Homo sapiens
gcaattttttttagt

SEQ ID NO: 40851 - DNA, 15 bp, Homo sapiens
ggcaattttttttag

SEQ ID NO: 40852 - DNA, 15 bp, Homo sapiens
cggcaatttttttta

SEQ ID NO: 40853 - DNA, 15 bp, Homo sapiens
ccggcaatttttttt

SEQ ID NO: 40854 - DNA, 15 bp, Homo sapiens
cccggcaattttttt

SEQ ID NO: 40855 - DNA, 15 bp, Homo sapiens
acccggcaatttttt

SEQ ID NO: 40856 - DNA, 15 bp, Homo sapiens
cacccggcaattttt

SEQ ID NO: 40857 - DNA, 15 bp, Homo sapiens
gcacccggcaatttt

SEQ ID NO: 40858 - DNA, 15 bp, Homo sapiens
cgcacccggcaattt

SEQ ID NO: 40859 - DNA, 15 bp, Homo sapiens
ccgcacccggcaatt

SEQ ID NO: 40860 - DNA, 15 bp, Homo sapiens
accgcacccggcaat

SEQ ID NO: 40861 - DNA, 15 bp, Homo sapiens
caccgcacccggcaa

SEQ ID NO: 40862 - DNA, 15 bp, Homo sapiens
ccaccgcacccggca

SEQ ID NO: 40863 - DNA, 15 bp, Homo sapiens
tcgcccgcctcggcc

SEQ ID NO: 40864 - DNA, 15 bp, Homo sapiens
ttcgcccgcctcggc

SEQ ID NO: 40865 - DNA, 15 bp, Homo sapiens
attcgcccgcctcgg

SEQ ID NO: 40866 - DNA, 15 bp, Homo sapiens
gattcgcccgcctcg

SEQ ID NO: 40867 - DNA, 15 bp, Homo sapiens
tgattcgcccgcctc

SEQ ID NO: 40868 - DNA, 15 bp, Homo sapiens
atgattcgcccgcct

SEQ ID NO: 40869 - DNA, 15 bp, Homo sapiens
catgattcgcccgcc

SEQ ID NO: 40870 - DNA, 15 bp, Homo sapiens
tcatgattcgcccgc

SEQ ID NO: 40871 - DNA, 15 bp, Homo sapiens
ctcatgattcgcccg

SEQ ID NO: 40872 - DNA, 15 bp, Homo sapiens
cctcatgattcgccc

SEQ ID NO: 40873 - DNA, 15 bp, Homo sapiens
acctcatgattcgcc

SEQ ID NO: 40874 - DNA, 15 bp, Homo sapiens
gacctcatgattcgc

SEQ ID NO: 40875 - DNA, 15 bp, Homo sapiens
tgacctcatgattcg

SEQ ID NO: 40876 - DNA, 15 bp, Homo sapiens
ctgacctcatgattc

SEQ ID NO: 40877 - DNA, 15 bp, Homo sapiens
cctgacctcatgatt

SEQ ID NO: 40878 - DNA, 15 bp, Homo sapiens
tcctgacctcatgat

SEQ ID NO: 40879 - DNA, 15 bp, Homo sapiens
ctcctgacctcatga

SEQ ID NO: 40880 - DNA, 15 bp, Homo sapiens
tctcctgacctcatg

SEQ ID NO: 40881 - DNA, 15 bp, Homo sapiens
atctcctgacctcat

SEQ ID NO: 40882 - DNA, 15 bp, Homo sapiens
aatctcctgacctca

SEQ ID NO: 40883 - DNA, 15 bp, Homo sapiens
caatctcctgacctc

SEQ ID NO: 40884 - DNA, 15 bp, Homo sapiens
tcaatctcctgacct

SEQ ID NO: 40885 - DNA, 15 bp, Homo sapiens
ctcaatctcctgacc

SEQ ID NO: 40886 - DNA, 15 bp, Homo sapiens
tctcaatctcctgac

SEQ ID NO: 40887 - DNA, 15 bp, Homo sapiens
gtctcaatctcctga

SEQ ID NO: 40888 - DNA, 15 bp, Homo sapiens
ggtctcaatctcctg

SEQ ID NO: 40889 - DNA, 15 bp, Homo sapiens
tggtctcaatctcct

SEQ ID NO: 40890 - DNA, 15 bp, Homo sapiens
atggtctcaatctcc

SEQ ID NO: 40891 - DNA, 15 bp, Homo sapiens
gatggtctcaatctc

SEQ ID NO: 40892 - DNA, 15 bp, Homo sapiens
ggatggtctcaatct

SEQ ID NO: 40893 - DNA, 15 bp, Homo sapiens
aggatggtctcaatc

SEQ ID NO: 40894 - DNA, 15 bp, Homo sapiens
caggatggtctcaat

SEQ ID NO: 40895 - DNA, 15 bp, Homo sapiens
ccaggatggtctcaa

SEQ ID NO: 40896 - DNA, 15 bp, Homo sapiens
gccaggatggtctca

SEQ ID NO: 40897 - DNA, 15 bp, Homo sapiens
atgttagccaggatg

SEQ ID NO: 40898 - DNA, 15 bp, Homo sapiens
catgttagccaggat

SEQ ID NO: 40899 - DNA, 15 bp, Homo sapiens
ccatgttagccagga

SEQ ID NO: 40900 - DNA, 15 bp, Homo sapiens
accatgttagccagg

SEQ ID NO: 40901 - DNA, 15 bp, Homo sapiens
caccatgttagccag

SEQ ID NO: 40902 - DNA, 15 bp, Homo sapiens
ggagacggggtttca

SEQ ID NO: 40903 - DNA, 15 bp, Homo sapiens
tggagacggggtttc

SEQ ID NO: 40904 - DNA, 15 bp, Homo sapiens
gtggagacggggttt

SEQ ID NO: 40905 - DNA, 15 bp, Homo sapiens
agtggagacggggtt

SEQ ID NO: 40906 - DNA, 15 bp, Homo sapiens
tagtggagacggggt

SEQ ID NO: 40907 - DNA, 15 bp, Homo sapiens
ttagtggagacgggg

SEQ ID NO: 40908 - DNA, 15 bp, Homo sapiens
tttagtggagacggg

SEQ ID NO: 40909 - DNA, 15 bp, Homo sapiens
ttttagtggagacgg

SEQ ID NO: 40910 - DNA, 15 bp, Homo sapiens
tttttagtggagacg

SEQ ID NO: 40911 - DNA, 15 bp, Homo sapiens
atttttagtggagac

SEQ ID NO: 40912 - DNA, 15 bp, Homo sapiens
aatttttagtggaga

SEQ ID NO: 40913 - DNA, 15 bp, Homo sapiens
gaatttttagtggag

SEQ ID NO: 40914 - DNA, 15 bp, Homo sapiens
tgaatttttagtgga

SEQ ID NO: 40915 - DNA, 15 bp, Homo sapiens
ttgaatttttagtgg

SEQ ID NO: 40916 - DNA, 15 bp, Homo sapiens
tttgaatttttagtg

SEQ ID NO: 40917 - DNA, 15 bp, Homo sapiens
tttttgaatttttag

SEQ ID NO: 40918 - DNA, 15 bp, Homo sapiens
ttttttgaattttta

SEQ ID NO: 40919 - DNA, 15 bp, Homo sapiens
attttttgaattttt

SEQ ID NO: 40920 - DNA, 15 bp, Homo sapiens
aattttttgaatttt

SEQ ID NO: 40921 - DNA, 15 bp, Homo sapiens
taattttttgaattt

SEQ ID NO: 40922 - DNA, 15 bp, Homo sapiens
ctaattttttgaatt

SEQ ID NO: 40923 - DNA, 15 bp, Homo sapiens
gctaattttttgaat

SEQ ID NO: 40924 - DNA, 15 bp, Homo sapiens
ggctaattttttgaa

SEQ ID NO: 40925 - DNA, 15 bp, Homo sapiens
cggctaattttttga

SEQ ID NO: 40926 - DNA, 15 bp, Homo sapiens
ccggctaattttttg

SEQ ID NO: 40927 - DNA, 15 bp, Homo sapiens
cccggctaatttttt

SEQ ID NO: 40928 - DNA, 15 bp, Homo sapiens
cgcccggctaatttt

SEQ ID NO: 40929 - DNA, 15 bp, Homo sapiens
acgcccggctaattt

SEQ ID NO: 40930 - DNA, 15 bp, Homo sapiens
cacgcccggctaatt

SEQ ID NO: 40931 - DNA, 15 bp, Homo sapiens
ccacgcccggctaat

SEQ ID NO: 40932 - DNA, 15 bp, Homo sapiens
accacgcccggctaa

SEQ ID NO: 40933 - DNA, 15 bp, Homo sapiens
caccacgcccggcta

SEQ ID NO: 40934 - DNA, 15 bp, Homo sapiens
ccaccacgcccggct

SEQ ID NO: 40935 - DNA, 15 bp, Homo sapiens
accaccacgcccggc

SEQ ID NO: 40936 - DNA, 15 bp, Homo sapiens
caccaccacgcccgg

SEQ ID NO: 40937 - DNA, 15 bp, Homo sapiens
ccaccaccacgcccg

SEQ ID NO: 40938 - DNA, 15 bp, Homo sapiens
cccaccaccacgccc

SEQ ID NO: 40939 - DNA, 15 bp, Homo sapiens
cacccaccaccacgc

SEQ ID NO: 40940 - DNA, 15 bp, Homo sapiens
gcacccaccaccacg

SEQ ID NO: 40941 - DNA, 15 bp, Homo sapiens
ggcacccaccaccac

SEQ ID NO: 40942 - DNA, 15 bp, Homo sapiens
aggcacccaccacca

SEQ ID NO: 40943 - DNA, 15 bp, Homo sapiens
taggcacccaccacc

SEQ ID NO: 40944 - DNA, 15 bp, Homo sapiens
ataggcacccaccac

SEQ ID NO: 40945 - DNA, 15 bp, Homo sapiens
tataggcacccacca

SEQ ID NO: 40946 - DNA, 15 bp, Homo sapiens
ctataggcacccacc

SEQ ID NO: 40947 - DNA, 15 bp, Homo sapiens
actataggcacccac

SEQ ID NO: 40948 - DNA, 15 bp, Homo sapiens
gactataggcaccca

SEQ ID NO: 40949 - DNA, 15 bp, Homo sapiens
ggactataggcaccc

SEQ ID NO: 40950 - DNA, 15 bp, Homo sapiens
gggactataggcacc

SEQ ID NO: 40951 - DNA, 15 bp, Homo sapiens
tgggactataggcac

SEQ ID NO: 40952 - DNA, 15 bp, Homo sapiens
ctgggactataggca

SEQ ID NO: 40953 - DNA, 15 bp, Homo sapiens
gctgggactataggc

SEQ ID NO: 40954 - DNA, 15 bp, Homo sapiens
agctgggactatagg

SEQ ID NO: 40955 - DNA, 15 bp, Homo sapiens
tagctgggactatag

SEQ ID NO: 40956 - DNA, 15 bp, Homo sapiens
gtagctgggactata

SEQ ID NO: 40957 - DNA, 15 bp, Homo sapiens
agtagctgggactat

SEQ ID NO: 40958 - DNA, 15 bp, Homo sapiens
tgagtagctgggact

SEQ ID NO: 40959 - DNA, 15 bp, Homo sapiens
ctgagtagctgggac

SEQ ID NO: 40960 - DNA, 15 bp, Homo sapiens
cgttctcctgcctca

SEQ ID NO: 40961 - DNA, 15 bp, Homo sapiens
ccgttctcctgcctc

SEQ ID NO: 40962 - DNA, 15 bp, Homo sapiens
gccgttctcctgcct

SEQ ID NO: 40963 - DNA, 15 bp, Homo sapiens
tgccgttctcctgcc

SEQ ID NO: 40964 - DNA, 15 bp, Homo sapiens
atgccgttctcctgc

SEQ ID NO: 40965 - DNA, 15 bp, Homo sapiens
catgccgttctcctg

SEQ ID NO: 40966 - DNA, 15 bp, Homo sapiens
tcatgccgttctcct

SEQ ID NO: 40967 - DNA, 15 bp, Homo sapiens
ttcatgccgttctcc

SEQ ID NO: 40968 - DNA, 15 bp, Homo sapiens
gttcatgccgttctc

SEQ ID NO: 40969 - DNA, 15 bp, Homo sapiens
ggttcatgccgttct

SEQ ID NO: 40970 - DNA, 15 bp, Homo sapiens
gggttcatgccgttc

SEQ ID NO: 40971 - DNA, 15 bp, Homo sapiens
cgggttcatgccgtt

SEQ ID NO: 40972 - DNA, 15 bp, Homo sapiens
ccgggttcatgccgt

SEQ ID NO: 40973 - DNA, 15 bp, Homo sapiens
cccgggttcatgccg

SEQ ID NO: 40974 - DNA, 15 bp, Homo sapiens
tcccgggttcatgcc

SEQ ID NO: 40975 - DNA, 15 bp, Homo sapiens
ctcccgggttcatgc

SEQ ID NO: 40976 - DNA, 15 bp, Homo sapiens
cctcccgggttcatg

SEQ ID NO: 40977 - DNA, 15 bp, Homo sapiens
gcctcccgggttcat

SEQ ID NO: 40978 - DNA, 15 bp, Homo sapiens
gctccgcctcccggg

SEQ ID NO: 40979 - DNA, 15 bp, Homo sapiens
agctccgcctcccgg

SEQ ID NO: 40980 - DNA, 15 bp, Homo sapiens
aagctccgcctcccg

SEQ ID NO: 40981 - DNA, 15 bp, Homo sapiens
caagctccgcctccc

SEQ ID NO: 40982 - DNA, 15 bp, Homo sapiens
gcaagctccgcctcc

SEQ ID NO: 40983 - DNA, 15 bp, Homo sapiens
tgcaagctccgcctc

SEQ ID NO: 40984 - DNA, 15 bp, Homo sapiens
ctgcaagctccgcct

SEQ ID NO: 40985 - DNA, 15 bp, Homo sapiens
actgcaagctccgcc

SEQ ID NO: 40986 - DNA, 15 bp, Homo sapiens
cactgcaagctccgc

SEQ ID NO: 40987 - DNA, 15 bp, Homo sapiens
tcactgcaagctccg

SEQ ID NO: 40988 - DNA, 15 bp, Homo sapiens
ctcactgcaagctcc

SEQ ID NO: 40989 - DNA, 15 bp, Homo sapiens
gctcactgcaagctc

SEQ ID NO: 40990 - DNA, 15 bp, Homo sapiens
ggctcactgcaagct

SEQ ID NO: 40991 - DNA, 15 bp, Homo sapiens
cggctcactgcaagc

SEQ ID NO: 40992 - DNA, 15 bp, Homo sapiens
tcggctcactgcaag

SEQ ID NO: 40993 - DNA, 15 bp, Homo sapiens
tgcgatctcggctca

SEQ ID NO: 40994 - DNA, 15 bp, Homo sapiens
gtgcgatctcggctc

SEQ ID NO: 40995 - DNA, 15 bp, Homo sapiens
ggtgcgatctcggct

SEQ ID NO: 40996 - DNA, 15 bp, Homo sapiens
tggtgcgatctcggc

SEQ ID NO: 40997 - DNA, 15 bp, Homo sapiens
atggtgcgatctcgg

SEQ ID NO: 40998 - DNA, 15 bp, Homo sapiens
aatggtgcgatctcg

SEQ ID NO: 40999 - DNA, 15 bp, Homo sapiens
caatggtgcgatctc

SEQ ID NO: 41000 - DNA, 15 bp, Homo sapiens
gcaatggtgcgatct

SEQ ID NO: 41001 - DNA, 15 bp, Homo sapiens
tgcaatggtgcgatc

SEQ ID NO: 41002 - DNA, 15 bp, Homo sapiens
gtgcaatggtgcgat

SEQ ID NO: 41003 - DNA, 15 bp, Homo sapiens
agtgcaatggtgcga

SEQ ID NO: 41004 - DNA, 15 bp, Homo sapiens
gagtgcaatggtgcg

SEQ ID NO: 41005 - DNA, 15 bp, Homo sapiens
ggagtgcaatggtgc

SEQ ID NO: 41006 - DNA, 15 bp, Homo sapiens
tggagtgcaatggtg

SEQ ID NO: 41007 - DNA, 15 bp, Homo sapiens
ctggagtgcaatggt

SEQ ID NO: 41008 - DNA, 15 bp, Homo sapiens
tcttgctctgtcacc

SEQ ID NO: 41009 - DNA, 15 bp, Homo sapiens
gtcttgctctgtcac

SEQ ID NO: 41010 - DNA, 15 bp, Homo sapiens
agtcttgctctgtca

SEQ ID NO: 41011 - DNA, 15 bp, Homo sapiens
ggagtcttgctctgt

SEQ ID NO: 41012 - DNA, 15 bp, Homo sapiens
cggagtcttgctctg

SEQ ID NO: 41013 - DNA, 15 bp, Homo sapiens
acggagtcttgctct

SEQ ID NO: 41014 - DNA, 15 bp, Homo sapiens
gacggagtcttgctc

SEQ ID NO: 41015 - DNA, 15 bp, Homo sapiens
ttgtttttttttttt

SEQ ID NO: 41016 - DNA, 15 bp, Homo sapiens
gttgttttttttttt

SEQ ID NO: 41017 - DNA, 15 bp, Homo sapiens
tgttgtttttttttt

SEQ ID NO: 41018 - DNA, 15 bp, Homo sapiens
ttgttgttttttttt

SEQ ID NO: 41019 - DNA, 15 bp, Homo sapiens
gttgttgtttttttt

SEQ ID NO: 41020 - DNA, 15 bp, Homo sapiens
cgttgttgttttttt

SEQ ID NO: 41021 - DNA, 15 bp, Homo sapiens
tcgttgttgtttttt

SEQ ID NO: 41022 - DNA, 15 bp, Homo sapiens
ttcgttgttgttttt

SEQ ID NO: 41023 - DNA, 15 bp, Homo sapiens
tttcgttgttgtttt

SEQ ID NO: 41024 - DNA, 15 bp, Homo sapiens
ttttcgttgttgttt

SEQ ID NO: 41025 - DNA, 15 bp, Homo sapiens
attttcgttgttgtt

SEQ ID NO: 41026 - DNA, 15 bp, Homo sapiens
tattttcgttgttgt

SEQ ID NO: 41027 - DNA, 15 bp, Homo sapiens
gtattttcgttgttg

SEQ ID NO: 41028 - DNA, 15 bp, Homo sapiens
tgtattttcgttgtt

SEQ ID NO: 41029 - DNA, 15 bp, Homo sapiens
ttgtattttcgttgt

SEQ ID NO: 41030 - DNA, 15 bp, Homo sapiens
tttgtattttcgttg

SEQ ID NO: 41031 - DNA, 15 bp, Homo sapiens
ttttgtattttcgtt

SEQ ID NO: 41032 - DNA, 15 bp, Homo sapiens
tttttgtattttcgt

SEQ ID NO: 41033 - DNA, 15 bp, Homo sapiens
ttttttgtattttcg

SEQ ID NO: 41034 - DNA, 15 bp, Homo sapiens
attttttgtattttc

SEQ ID NO: 41035 - DNA, 15 bp, Homo sapiens
taattttttgtattt

SEQ ID NO: 41036 - DNA, 15 bp, Homo sapiens
ctaattttttgtatt

SEQ ID NO: 41037 - DNA, 15 bp, Homo sapiens
gctaattttttgtat

SEQ ID NO: 41038 - DNA, 15 bp, Homo sapiens
agctaattttttgta

SEQ ID NO: 41039 - DNA, 15 bp, Homo sapiens
cagctaattttttgt

SEQ ID NO: 41040 - DNA, 15 bp, Homo sapiens
ccagctaattttttg

SEQ ID NO: 41041 - DNA, 15 bp, Homo sapiens
ctgccaccatgccca

SEQ ID NO: 41042 - DNA, 15 bp, Homo sapiens
actgccaccatgccc

SEQ ID NO: 41043 - DNA, 15 bp, Homo sapiens
aactgccaccatgcc

SEQ ID NO: 41044 - DNA, 15 bp, Homo sapiens
caactgccaccatgc

SEQ ID NO: 41045 - DNA, 15 bp, Homo sapiens
gcaactgccaccatg

SEQ ID NO: 41046 - DNA, 15 bp, Homo sapiens
ggcaactgccaccat

SEQ ID NO: 41047 - DNA, 15 bp, Homo sapiens
aggcaactgccacca

SEQ ID NO: 41048 - DNA, 15 bp, Homo sapiens
caggcaactgccacc

SEQ ID NO: 41049 - DNA, 15 bp, Homo sapiens
acaggcaactgccac

SEQ ID NO: 41050 - DNA, 15 bp, Homo sapiens
tacaggcaactgcca

SEQ ID NO: 41051 - DNA, 15 bp, Homo sapiens
ctacaggcaactgcc

SEQ ID NO: 41052 - DNA, 15 bp, Homo sapiens
actacaggcaactgc

SEQ ID NO: 41053 - DNA, 15 bp, Homo sapiens
gactacaggcaactg

SEQ ID NO: 41054 - DNA, 15 bp, Homo sapiens
ggactacaggcaact

SEQ ID NO: 41055 - DNA, 15 bp, Homo sapiens
gggactacaggcaac

SEQ ID NO: 41056 - DNA, 15 bp, Homo sapiens
tgggactacaggcaa

SEQ ID NO: 41057 - DNA, 15 bp, Homo sapiens
ttgcctcagcctcct

SEQ ID NO: 41058 - DNA, 15 bp, Homo sapiens
cattctcttgcctca

SEQ ID NO: 41059 - DNA, 15 bp, Homo sapiens
tcattctcttgcctc

SEQ ID NO: 41060 - DNA, 15 bp, Homo sapiens
ttcattctcttgcct

SEQ ID NO: 41061 - DNA, 15 bp, Homo sapiens
attcattctcttgcc

SEQ ID NO: 41062 - DNA, 15 bp, Homo sapiens
cattcattctcttgc

SEQ ID NO: 41063 - DNA, 15 bp, Homo sapiens
ccattcattctcttg

SEQ ID NO: 41064 - DNA, 15 bp, Homo sapiens
gccattcattctctt

SEQ ID NO: 41065 - DNA, 15 bp, Homo sapiens
cgccattcattctct

SEQ ID NO: 41066 - DNA, 15 bp, Homo sapiens
acgccattcattctc

SEQ ID NO: 41067 - DNA, 15 bp, Homo sapiens
cacgccattcattct

SEQ ID NO: 41068 - DNA, 15 bp, Homo sapiens
tcacgccattcattc

SEQ ID NO: 41069 - DNA, 15 bp, Homo sapiens
ttcacgccattcatt

SEQ ID NO: 41070 - DNA, 15 bp, Homo sapiens
gttcacgccattcat

SEQ ID NO: 41071 - DNA, 15 bp, Homo sapiens
cgttcacgccattca

SEQ ID NO: 41072 - DNA, 15 bp, Homo sapiens
acgttcacgccattc

SEQ ID NO: 41073 - DNA, 15 bp, Homo sapiens
cacgttcacgccatt

SEQ ID NO: 41074 - DNA, 15 bp, Homo sapiens
gcacgttcacgccat

SEQ ID NO: 41075 - DNA, 15 bp, Homo sapiens
ggcacgttcacgcca

SEQ ID NO: 41076 - DNA, 15 bp, Homo sapiens
tggcacgttcacgcc

SEQ ID NO: 41077 - DNA, 15 bp, Homo sapiens
gtggcacgttcacgc

SEQ ID NO: 41078 - DNA, 15 bp, Homo sapiens
agtggcacgttcacg

SEQ ID NO: 41079 - DNA, 15 bp, Homo sapiens
cagtggcacgttcac

SEQ ID NO: 41080 - DNA, 15 bp, Homo sapiens
gcagtggcacgttca

SEQ ID NO: 41081 - DNA, 15 bp, Homo sapiens
tgcagtggcacgttc

SEQ ID NO: 41082 - DNA, 15 bp, Homo sapiens
atgcagtggcacgtt

SEQ ID NO: 41083 - DNA, 15 bp, Homo sapiens
aatgcagtggcacgt

SEQ ID NO: 41084 - DNA, 15 bp, Homo sapiens
gaatgcagtggcacg

SEQ ID NO: 41085 - DNA, 15 bp, Homo sapiens
ggaatgcagtggcac

SEQ ID NO: 41086 - DNA, 15 bp, Homo sapiens
tggaatgcagtggca

SEQ ID NO: 41087 - DNA, 15 bp, Homo sapiens
ctggaatgcagtggc

SEQ ID NO: 41088 - DNA, 15 bp, Homo sapiens
gctggaatgcagtgg

SEQ ID NO: 41089 - DNA, 15 bp, Homo sapiens
ggctggaatgcagtg

SEQ ID NO: 41090 - DNA, 15 bp, Homo sapiens
aggctggaatgcagt

SEQ ID NO: 41091 - DNA, 15 bp, Homo sapiens
caggctggaatgcag

SEQ ID NO: 41092 - DNA, 15 bp, Homo sapiens
ccaggctggaatgca

SEQ ID NO: 41093 - DNA, 15 bp, Homo sapiens
cccaggctggaatgc

SEQ ID NO: 41094 - DNA, 15 bp, Homo sapiens
gcccaggctggaatg

SEQ ID NO: 41095 - DNA, 15 bp, Homo sapiens
cgcccaggctggaat

SEQ ID NO: 41096 - DNA, 15 bp, Homo sapiens
tcgcccaggctggaa

SEQ ID NO: 41097 - DNA, 15 bp, Homo sapiens
gtcgcccaggctgga

SEQ ID NO: 41098 - DNA, 15 bp, Homo sapiens
tgtcgcccaggctgg

SEQ ID NO: 41099 - DNA, 15 bp, Homo sapiens
gtgtcgcccaggctg

SEQ ID NO: 41100 - DNA, 15 bp, Homo sapiens
tgtgtcgcccaggct

SEQ ID NO: 41101 - DNA, 15 bp, Homo sapiens
ctgtgtcgcccaggc

SEQ ID NO: 41102 - DNA, 15 bp, Homo sapiens
gctgtgtcgcccagg

SEQ ID NO: 41103 - DNA, 15 bp, Homo sapiens
cgctgtgtcgcccag

SEQ ID NO: 41104 - DNA, 15 bp, Homo sapiens
tcgctgtgtcgccca

SEQ ID NO: 41105 - DNA, 15 bp, Homo sapiens
ctcgctgtgtcgccc

SEQ ID NO: 41106 - DNA, 15 bp, Homo sapiens
tctcgctgtgtcgcc

SEQ ID NO: 41107 - DNA, 15 bp, Homo sapiens
gtctcgctgtgtcgc

SEQ ID NO: 41108 - DNA, 15 bp, Homo sapiens
agtctcgctgtgtcg

SEQ ID NO: 41109 - DNA, 15 bp, Homo sapiens
gagtctcgctgtgtc

SEQ ID NO: 41110 - DNA, 15 bp, Homo sapiens
agagtctcgctgtgt

SEQ ID NO: 41111 - DNA, 15 bp, Homo sapiens
tagagtctcgctgtg

SEQ ID NO: 41112 - DNA, 15 bp, Homo sapiens
gtagagtctcgctgt

SEQ ID NO: 41113 - DNA, 15 bp, Homo sapiens
agtagagtctcgctg

SEQ ID NO: 41114 - DNA, 15 bp, Homo sapiens
cagtagagtctcgct

SEQ ID NO: 41115 - DNA, 15 bp, Homo sapiens
tcagtagagtctcgc

SEQ ID NO: 41116 - DNA, 15 bp, Homo sapiens
atcagtagagtctcg

SEQ ID NO: 41117 - DNA, 15 bp, Homo sapiens
gatcagtagagtctc

SEQ ID NO: 41118 - DNA, 15 bp, Homo sapiens
tgatcagtagagtct

SEQ ID NO: 41119 - DNA, 15 bp, Homo sapiens
ctgatcagtagagtc

SEQ ID NO: 41120 - DNA, 15 bp, Homo sapiens
actgatcagtagagt

SEQ ID NO: 41121 - DNA, 15 bp, Homo sapiens
aactgatcagtagag

SEQ ID NO: 41122 - DNA, 15 bp, Homo sapiens
gaactgatcagtaga

SEQ ID NO: 41123 - DNA, 15 bp, Homo sapiens
agaactgatcagtag

SEQ ID NO: 41124 - DNA, 15 bp, Homo sapiens
cagaactgatcagta

SEQ ID NO: 41125 - DNA, 15 bp, Homo sapiens
gcagaactgatcagt

SEQ ID NO: 41126 - DNA, 15 bp, Homo sapiens
agcagaactgatcag

SEQ ID NO: 41127 - DNA, 15 bp, Homo sapiens
cagcagaactgatca

SEQ ID NO: 41128 - DNA, 15 bp, Homo sapiens
tcagcagaactgatc

SEQ ID NO: 41129 - DNA, 15 bp, Homo sapiens
atcagcagaactgat

SEQ ID NO: 41130 - DNA, 15 bp, Homo sapiens
catcagcagaactga

SEQ ID NO: 41131 - DNA, 15 bp, Homo sapiens
ccatcagcagaactg

SEQ ID NO: 41132 - DNA, 15 bp, Homo sapiens
tccatcagcagaact

SEQ ID NO: 41133 - DNA, 15 bp, Homo sapiens
ctccatcagcagaac

SEQ ID NO: 41134 - DNA, 15 bp, Homo sapiens
tctccatcagcagaa

SEQ ID NO: 41135 - DNA, 15 bp, Homo sapiens
ttctccatcagcaga

SEQ ID NO: 41136 - DNA, 15 bp, Homo sapiens
tttctccatcagcag

SEQ ID NO: 41137 - DNA, 15 bp, Homo sapiens
ttttctccatcagca

SEQ ID NO: 41138 - DNA, 15 bp, Homo sapiens
tttttctccatcagc

SEQ ID NO: 41139 - DNA, 15 bp, Homo sapiens
ttttttctccatcag

SEQ ID NO: 41140 - DNA, 15 bp, Homo sapiens
tttttttctccatca

SEQ ID NO: 41141 - DNA, 15 bp, Homo sapiens
ttttttttctccatc

SEQ ID NO: 41142 - DNA, 15 bp, Homo sapiens
attttttttctccat

SEQ ID NO: 41143 - DNA, 15 bp, Homo sapiens
aattttttttctcca

SEQ ID NO: 41144 - DNA, 15 bp, Homo sapiens
aaattttttttctcc

SEQ ID NO: 41145 - DNA, 15 bp, Homo sapiens
caaattttttttctc

SEQ ID NO: 41146 - DNA, 15 bp, Homo sapiens
tcaaattttttttct

SEQ ID NO: 41147 - DNA, 15 bp, Homo sapiens
atcaaattttttttc

SEQ ID NO: 41148 - DNA, 15 bp, Homo sapiens
tatcaaatttttttt

SEQ ID NO: 41149 - DNA, 15 bp, Homo sapiens
ttatcaaattttttt

SEQ ID NO: 41150 - DNA, 15 bp, Homo sapiens
tttatcaaatttttt

SEQ ID NO: 41151 - DNA, 15 bp, Homo sapiens
ttttatcaaattttt

SEQ ID NO: 41152 - DNA, 15 bp, Homo sapiens
attttatcaaatttt

SEQ ID NO: 41153 - DNA, 15 bp, Homo sapiens
aattttatcaaattt

SEQ ID NO: 41154 - DNA, 15 bp, Homo sapiens
aaattttatcaaatt

SEQ ID NO: 41155 - DNA, 15 bp, Homo sapiens
taaattttatcaaat

SEQ ID NO: 41156 - DNA, 15 bp, Homo sapiens
ttaaattttatcaaa

SEQ ID NO: 41157 - DNA, 15 bp, Homo sapiens
gttaaattttatcaa

SEQ ID NO: 41158 - DNA, 15 bp, Homo sapiens
tgttaaattttatca

SEQ ID NO: 41159 - DNA, 15 bp, Homo sapiens
atgttaaattttatc

SEQ ID NO: 41160 - DNA, 15 bp, Homo sapiens
gatgttaaattttat

SEQ ID NO: 41161 - DNA, 15 bp, Homo sapiens
ggatgttaaatttta

SEQ ID NO: 41162 - DNA, 15 bp, Homo sapiens
tggatgttaaatttt

SEQ ID NO: 41163 - DNA, 15 bp, Homo sapiens
atggatgttaaattt

SEQ ID NO: 41164 - DNA, 15 bp, Homo sapiens
aatggatgttaaatt

SEQ ID NO: 41165 - DNA, 15 bp, Homo sapiens
aaatggatgttaaat

SEQ ID NO: 41166 - DNA, 15 bp, Homo sapiens
aaaatggatgttaaa

SEQ ID NO: 41167 - DNA, 15 bp, Homo sapiens
gaaaatggatgttaa

SEQ ID NO: 41168 - DNA, 15 bp, Homo sapiens
agaaaatggatgtta

SEQ ID NO: 41169 - DNA, 15 bp, Homo sapiens
tagaaaatggatgtt

SEQ ID NO: 41170 - DNA, 15 bp, Homo sapiens
ttagaaaatggatgt

SEQ ID NO: 41171 - DNA, 15 bp, Homo sapiens
tttagaaaatggatg

SEQ ID NO: 41172 - DNA, 15 bp, Homo sapiens
ttttagaaaatggat

SEQ ID NO: 41173 - DNA, 15 bp, Homo sapiens
tttttagaaaatgga

SEQ ID NO: 41174 - DNA, 15 bp, Homo sapiens
atttttagaaaatgg

SEQ ID NO: 41175 - DNA, 15 bp, Homo sapiens
aatttttagaaaatg

SEQ ID NO: 41176 - DNA, 15 bp, Homo sapiens
taatttttagaaaat

SEQ ID NO: 41177 - DNA, 15 bp, Homo sapiens
ataatttttagaaaa

SEQ ID NO: 41178 - DNA, 15 bp, Homo sapiens
aataatttttagaaa

SEQ ID NO: 41179 - DNA, 15 bp, Homo sapiens
gaataatttttagaa

SEQ ID NO: 41180 - DNA, 15 bp, Homo sapiens
ggaataatttttaga

SEQ ID NO: 41181 - DNA, 15 bp, Homo sapiens
aggaataatttttag

SEQ ID NO: 41182 - DNA, 15 bp, Homo sapiens
taggaataattttta

SEQ ID NO: 41183 - DNA, 15 bp, Homo sapiens
ataggaataattttt

SEQ ID NO: 41184 - DNA, 15 bp, Homo sapiens
cataggaataatttt

SEQ ID NO: 41185 - DNA, 15 bp, Homo sapiens
acataggaataattt

SEQ ID NO: 41186 - DNA, 15 bp, Homo sapiens
tacataggaataatt

SEQ ID NO: 41187 - DNA, 15 bp, Homo sapiens
gtacataggaataat

SEQ ID NO: 41188 - DNA, 15 bp, Homo sapiens
ggtacataggaataa

SEQ ID NO: 41189 - DNA, 15 bp, Homo sapiens
tggtacataggaata

SEQ ID NO: 41190 - DNA, 15 bp, Homo sapiens
atggtacataggaat

SEQ ID NO: 41191 - DNA, 15 bp, Homo sapiens
aatggtacataggaa

SEQ ID NO: 41192 - DNA, 15 bp, Homo sapiens
aaatggtacatagga

SEQ ID NO: 41193 - DNA, 15 bp, Homo sapiens
taaatggtacatagg

SEQ ID NO: 41194 - DNA, 15 bp, Homo sapiens
ataaatggtacatag

SEQ ID NO: 41195 - DNA, 15 bp, Homo sapiens
aataaatggtacata

SEQ ID NO: 41196 - DNA, 15 bp, Homo sapiens
taataaatggtacat

SEQ ID NO: 41197 - DNA, 15 bp, Homo sapiens
ataataaatggtaca

SEQ ID NO: 41198 - DNA, 15 bp, Homo sapiens
aataataaatggtac

SEQ ID NO: 41199 - DNA, 15 bp, Homo sapiens
taataataaatggta

SEQ ID NO: 41200 - DNA, 15 bp, Homo sapiens
ctaataataaatggt

SEQ ID NO: 41201 - DNA, 15 bp, Homo sapiens
tctaataataaatgg

SEQ ID NO: 41202 - DNA, 15 bp, Homo sapiens
ttctaataataaatg

SEQ ID NO: 41203 - DNA, 15 bp, Homo sapiens
tttctaataataaat

SEQ ID NO: 41204 - DNA, 15 bp, Homo sapiens
gtttctaataataaa

SEQ ID NO: 41205 - DNA, 15 bp, Homo sapiens
ggtttctaataataa

SEQ ID NO: 41206 - DNA, 15 bp, Homo sapiens
tggtttctaataata

SEQ ID NO: 41207 - DNA, 15 bp, Homo sapiens
ttggtttctaataat

SEQ ID NO: 41208 - DNA, 15 bp, Homo sapiens
tttggtttctaataa

SEQ ID NO: 41209 - DNA, 15 bp, Homo sapiens
ttttggtttctaata

SEQ ID NO: 41210 - DNA, 15 bp, Homo sapiens
cttttggtttctaat

SEQ ID NO: 41211 - DNA, 15 bp, Homo sapiens
acttttggtttctaa

SEQ ID NO: 41212 - DNA, 15 bp, Homo sapiens
cacttttggtttcta

SEQ ID NO: 41213 - DNA, 15 bp, Homo sapiens
acacttttggtttct

SEQ ID NO: 41214 - DNA, 15 bp, Homo sapiens
aacacttttggtttc

SEQ ID NO: 41215 - DNA, 15 bp, Homo sapiens
taacacttttggttt

SEQ ID NO: 41216 - DNA, 15 bp, Homo sapiens
ttaacacttttggtt

SEQ ID NO: 41217 - DNA, 15 bp, Homo sapiens
gttaacacttttggt

SEQ ID NO: 41218 - DNA, 15 bp, Homo sapiens
cgttaacacttttgg

SEQ ID NO: 41219 - DNA, 15 bp, Homo sapiens
gcgttaacacttttg

SEQ ID NO: 41220 - DNA, 15 bp, Homo sapiens
agcgttaacactttt

SEQ ID NO: 41221 - DNA, 15 bp, Homo sapiens
aagcgttaacacttt

SEQ ID NO: 41222 - DNA, 15 bp, Homo sapiens
aaagcgttaacactt

SEQ ID NO: 41223 - DNA, 15 bp, Homo sapiens
taaagcgttaacact

SEQ ID NO: 41224 - DNA, 15 bp, Homo sapiens
ctaaagcgttaacac

SEQ ID NO: 41225 - DNA, 15 bp, Homo sapiens
tctaaagcgttaaca

SEQ ID NO: 41226 - DNA, 15 bp, Homo sapiens
ctctaaagcgttaac

SEQ ID NO: 41227 - DNA, 15 bp, Homo sapiens
actctaaagcgttaa

SEQ ID NO: 41228 - DNA, 15 bp, Homo sapiens
aactctaaagcgtta

SEQ ID NO: 41229 - DNA, 15 bp, Homo sapiens
caactctaaagcgtt

SEQ ID NO: 41230 - DNA, 15 bp, Homo sapiens
gcaactctaaagcgt

SEQ ID NO: 41231 - DNA, 15 bp, Homo sapiens
tgcaactctaaagcg

SEQ ID NO: 41232 - DNA, 15 bp, Homo sapiens
atgcaactctaaagc

SEQ ID NO: 41233 - DNA, 15 bp, Homo sapiens
aatgcaactctaaag

SEQ ID NO: 41234 - DNA, 15 bp, Homo sapiens
gaatgcaactctaaa

SEQ ID NO: 41235 - DNA, 15 bp, Homo sapiens
ggaatgcaactctaa

SEQ ID NO: 41236 - DNA, 15 bp, Homo sapiens
tggaatgcaactcta

SEQ ID NO: 41237 - DNA, 15 bp, Homo sapiens
ttggaatgcaactct

SEQ ID NO: 41238 - DNA, 15 bp, Homo sapiens
cttggaatgcaactc

SEQ ID NO: 41239 - DNA, 15 bp, Homo sapiens
acttggaatgcaact

SEQ ID NO: 41240 - DNA, 15 bp, Homo sapiens
gacttggaatgcaac

SEQ ID NO: 41241 - DNA, 15 bp, Homo sapiens
ggacttggaatgcaa

SEQ ID NO: 41242 - DNA, 15 bp, Homo sapiens
tggacttggaatgca

SEQ ID NO: 41243 - DNA, 15 bp, Homo sapiens
gtggacttggaatgc

SEQ ID NO: 41244 - DNA, 15 bp, Homo sapiens
agtggacttggaatg

SEQ ID NO: 41245 - DNA, 15 bp, Homo sapiens
gagtggacttggaat

SEQ ID NO: 41246 - DNA, 15 bp, Homo sapiens
agagtggacttggaa

SEQ ID NO: 41247 - DNA, 15 bp, Homo sapiens
aagagtggacttgga

SEQ ID NO: 41248 - DNA, 15 bp, Homo sapiens
caagagtggacttgg

SEQ ID NO: 41249 - DNA, 15 bp, Homo sapiens
gcaagagtggacttg

SEQ ID NO: 41250 - DNA, 15 bp, Homo sapiens
ggcaagagtggactt

SEQ ID NO: 41251 - DNA, 15 bp, Homo sapiens
gggcaagagtggact

SEQ ID NO: 41252 - DNA, 15 bp, Homo sapiens
tgggcaagagtggac

SEQ ID NO: 41253 - DNA, 15 bp, Homo sapiens
gtgggcaagagtgga

SEQ ID NO: 41254 - DNA, 15 bp, Homo sapiens
agtgggcaagagtgg

SEQ ID NO: 41255 - DNA, 15 bp, Homo sapiens
tagtgggcaagagtg

SEQ ID NO: 41256 - DNA, 15 bp, Homo sapiens
gtagtgggcaagagt

SEQ ID NO: 41257 - DNA, 15 bp, Homo sapiens
ggtagtgggcaagag

SEQ ID NO: 41258 - DNA, 15 bp, Homo sapiens
tggtagtgggcaaga

SEQ ID NO: 41259 - DNA, 15 bp, Homo sapiens
ttggtagtgggcaag

SEQ ID NO: 41260 - DNA, 15 bp, Homo sapiens
tttggtagtgggcaa

SEQ ID NO: 41261 - DNA, 15 bp, Homo sapiens
gtttggtagtgggca

SEQ ID NO: 41262 - DNA, 15 bp, Homo sapiens
tgtttggtagtgggc

SEQ ID NO: 41263 - DNA, 15 bp, Homo sapiens
gtgtttggtagtggg

SEQ ID NO: 41264 - DNA, 15 bp, Homo sapiens
agtgtttggtagtgg

SEQ ID NO: 41265 - DNA, 15 bp, Homo sapiens
cagtgtttggtagtg

SEQ ID NO: 41266 - DNA, 15 bp, Homo sapiens
acagtgtttggtagt

SEQ ID NO: 41267 - DNA, 15 bp, Homo sapiens
aacagtgtttggtag

SEQ ID NO: 41268 - DNA, 15 bp, Homo sapiens
gaacagtgtttggta

SEQ ID NO: 41269 - DNA, 15 bp, Homo sapiens
agaacagtgtttggt

SEQ ID NO: 41270 - DNA, 15 bp, Homo sapiens
tagaacagtgtttgg

SEQ ID NO: 41271 - DNA, 15 bp, Homo sapiens
ctagaacagtgtttg

SEQ ID NO: 41272 - DNA, 15 bp, Homo sapiens
tctagaacagtgttt

SEQ ID NO: 41273 - DNA, 15 bp, Homo sapiens
ctctagaacagtgtt

SEQ ID NO: 41274 - DNA, 15 bp, Homo sapiens
cctctagaacagtgt

SEQ ID NO: 41275 - DNA, 15 bp, Homo sapiens
acctctagaacagtg

SEQ ID NO: 41276 - DNA, 15 bp, Homo sapiens
cacctctagaacagt

SEQ ID NO: 41277 - DNA, 15 bp, Homo sapiens
gcacctctagaacag

SEQ ID NO: 41278 - DNA, 15 bp, Homo sapiens
agcacctctagaaca

SEQ ID NO: 41279 - DNA, 15 bp, Homo sapiens
tagcacctctagaac

SEQ ID NO: 41280 - DNA, 15 bp, Homo sapiens
ctagcacctctagaa

SEQ ID NO: 41281 - DNA, 15 bp, Homo sapiens
actagcacctctaga

SEQ ID NO: 41282 - DNA, 15 bp, Homo sapiens
gactagcacctctag

SEQ ID NO: 41283 - DNA, 15 bp, Homo sapiens
tgactagcacctcta

SEQ ID NO: 41284 - DNA, 15 bp, Homo sapiens
ctgactagcacctct

SEQ ID NO: 41285 - DNA, 15 bp, Homo sapiens
actgactagcacctc

SEQ ID NO: 41286 - DNA, 15 bp, Homo sapiens
tactgactagcacct

SEQ ID NO: 41287 - DNA, 15 bp, Homo sapiens
gtactgactagcacc

SEQ ID NO: 41288 - DNA, 15 bp, Homo sapiens
tgtactgactagcac

SEQ ID NO: 41289 - DNA, 15 bp, Homo sapiens
ttgtactgactagca

SEQ ID NO: 41290 - DNA, 15 bp, Homo sapiens
attgtactgactagc

SEQ ID NO: 41291 - DNA, 15 bp, Homo sapiens
gattgtactgactag

SEQ ID NO: 41292 - DNA, 15 bp, Homo sapiens
cgattgtactgacta

SEQ ID NO: 41293 - DNA, 15 bp, Homo sapiens
ccgattgtactgact

SEQ ID NO: 41294 - DNA, 15 bp, Homo sapiens
cccgattgtactgac

SEQ ID NO: 41295 - DNA, 15 bp, Homo sapiens
gcccgattgtactga

SEQ ID NO: 41296 - DNA, 15 bp, Homo sapiens
tgcccgattgtactg

SEQ ID NO: 41297 - DNA, 15 bp, Homo sapiens
gtgcccgattgtact

SEQ ID NO: 41298 - DNA, 15 bp, Homo sapiens
cgtgcccgattgtac

SEQ ID NO: 41299 - DNA, 15 bp, Homo sapiens
tcgtgcccgattgta

SEQ ID NO: 41300 - DNA, 15 bp, Homo sapiens
ctcgtgcccgattgt

SEQ ID NO: 41301 - DNA, 15 bp, Homo sapiens
tctcgtgcccgattg

SEQ ID NO: 41302 - DNA, 15 bp, Homo sapiens
ttctcgtgcccgatt

SEQ ID NO: 41303 - DNA, 15 bp, Homo sapiens
cttctcgtgcccgat

SEQ ID NO: 41304 - DNA, 15 bp, Homo sapiens
ccttctcgtgcccga

SEQ ID NO: 41305 - DNA, 15 bp, Homo sapiens
tccttctcgtgcccg

SEQ ID NO: 41306 - DNA, 15 bp, Homo sapiens
ttccttctcgtgccc

SEQ ID NO: 41307 - DNA, 15 bp, Homo sapiens
tttccttctcgtgcc

SEQ ID NO: 41308 - DNA, 15 bp, Homo sapiens
ttttccttctcgtgc

SEQ ID NO: 41309 - DNA, 15 bp, Homo sapiens
tttttccttctcgtg

SEQ ID NO: 41310 - DNA, 15 bp, Homo sapiens
ttttttccttctcgt

SEQ ID NO: 41311 - DNA, 15 bp, Homo sapiens
attttttccttctcg

SEQ ID NO: 41312 - DNA, 15 bp, Homo sapiens
cattttttccttctc

SEQ ID NO: 41313 - DNA, 15 bp, Homo sapiens
gcattttttccttct

SEQ ID NO: 41314 - DNA, 15 bp, Homo sapiens
ggcattttttccttc

SEQ ID NO: 41315 - DNA, 15 bp, Homo sapiens
aggcattttttcctt

SEQ ID NO: 41316 - DNA, 15 bp, Homo sapiens
aaggcattttttcct

SEQ ID NO: 41317 - DNA, 15 bp, Homo sapiens
caaggcattttttcc

SEQ ID NO: 41318 - DNA, 15 bp, Homo sapiens
ccaaggcattttttc

SEQ ID NO: 41319 - DNA, 15 bp, Homo sapiens
tccaaggcatttttt

SEQ ID NO: 41320 - DNA, 15 bp, Homo sapiens
ttccaaggcattttt

SEQ ID NO: 41321 - DNA, 15 bp, Homo sapiens
attccaaggcatttt

SEQ ID NO: 41322 - DNA, 15 bp, Homo sapiens
cattccaaggcattt

SEQ ID NO: 41323 - DNA, 15 bp, Homo sapiens
tcattccaaggcatt

SEQ ID NO: 41324 - DNA, 15 bp, Homo sapiens
ttcattccaaggcat

SEQ ID NO: 41325 - DNA, 15 bp, Homo sapiens
gttcattccaaggca

SEQ ID NO: 41326 - DNA, 15 bp, Homo sapiens
tgttcattccaaggc

SEQ ID NO: 41327 - DNA, 15 bp, Homo sapiens
ttgttcattccaagg

SEQ ID NO: 41328 - DNA, 15 bp, Homo sapiens
tttgttcattccaag

SEQ ID NO: 41329 - DNA, 15 bp, Homo sapiens
ttttgttcattccaa

SEQ ID NO: 41330 - DNA, 15 bp, Homo sapiens
tttttgttcattcca

SEQ ID NO: 41331 - DNA, 15 bp, Homo sapiens
ctttttgttcattcc

SEQ ID NO: 41332 - DNA, 15 bp, Homo sapiens
gctttttgttcattc

SEQ ID NO: 41333 - DNA, 15 bp, Homo sapiens
cgctttttgttcatt

SEQ ID NO: 41334 - DNA, 15 bp, Homo sapiens
tcgctttttgttcat

SEQ ID NO: 41335 - DNA, 15 bp, Homo sapiens
atcgctttttgttca

SEQ ID NO: 41336 - DNA, 15 bp, Homo sapiens
gatcgctttttgttc

SEQ ID NO: 41337 - DNA, 15 bp, Homo sapiens
tgatcgctttttgtt

SEQ ID NO: 41338 - DNA, 15 bp, Homo sapiens
ctgatcgctttttgt

SEQ ID NO: 41339 - DNA, 15 bp, Homo sapiens
cctgatcgctttttg

SEQ ID NO: 41340 - DNA, 15 bp, Homo sapiens
ccctgatcgcttttt

SEQ ID NO: 41341 - DNA, 15 bp, Homo sapiens
cccctgatcgctttt

SEQ ID NO: 41342 - DNA, 15 bp, Homo sapiens
acccctgatcgcttt

SEQ ID NO: 41343 - DNA, 15 bp, Homo sapiens
gacccctgatcgctt

SEQ ID NO: 41344 - DNA, 15 bp, Homo sapiens
tgacccctgatcgct

SEQ ID NO: 41345 - DNA, 15 bp, Homo sapiens
atgacccctgatcgc

SEQ ID NO: 41346 - DNA, 15 bp, Homo sapiens
tatgacccctgatcg

SEQ ID NO: 41347 - DNA, 15 bp, Homo sapiens
gtatgacccctgatc

SEQ ID NO: 41348 - DNA, 15 bp, Homo sapiens
agtatgacccctgat

SEQ ID NO: 41349 - DNA, 15 bp, Homo sapiens
cagtatgacccctga

SEQ ID NO: 41350 - DNA, 15 bp, Homo sapiens
ccagtatgacccctg

SEQ ID NO: 41351 - DNA, 15 bp, Homo sapiens
cccagtatgacccct

SEQ ID NO: 41352 - DNA, 15 bp, Homo sapiens
acccagtatgacccc

SEQ ID NO: 41353 - DNA, 15 bp, Homo sapiens
gacccagtatgaccc

SEQ ID NO: 41354 - DNA, 15 bp, Homo sapiens
tgacccagtatgacc

SEQ ID NO: 41355 - DNA, 15 bp, Homo sapiens
ttgacccagtatgac

SEQ ID NO: 41356 - DNA, 15 bp, Homo sapiens
attgacccagtatga

SEQ ID NO: 41357 - DNA, 15 bp, Homo sapiens
cattgacccagtatg

SEQ ID NO: 41358 - DNA, 15 bp, Homo sapiens
acattgacccagtat

SEQ ID NO: 41359 - DNA, 15 bp, Homo sapiens
aacattgacccagta

SEQ ID NO: 41360 - DNA, 15 bp, Homo sapiens
gaacattgacccagt

SEQ ID NO: 41361 - DNA, 15 bp, Homo sapiens
ggaacattgacccag

SEQ ID NO: 41362 - DNA, 15 bp, Homo sapiens
aggaacattgaccca

SEQ ID NO: 41363 - DNA, 15 bp, Homo sapiens
taggaacattgaccc

SEQ ID NO: 41364 - DNA, 15 bp, Homo sapiens
ctaggaacattgacc

SEQ ID NO: 41365 - DNA, 15 bp, Homo sapiens
tctaggaacattgac

SEQ ID NO: 41366 - DNA, 15 bp, Homo sapiens
gtctaggaacattga

SEQ ID NO: 41367 - DNA, 15 bp, Homo sapiens
tgtctaggaacattg

SEQ ID NO: 41368 - DNA, 15 bp, Homo sapiens
ctgtctaggaacatt

SEQ ID NO: 41369 - DNA, 15 bp, Homo sapiens
cctgtctaggaacat

SEQ ID NO: 41370 - DNA, 15 bp, Homo sapiens
tcctgtctaggaaca

SEQ ID NO: 41371 - DNA, 15 bp, Homo sapiens
ttcctgtctaggaac

SEQ ID NO: 41372 - DNA, 15 bp, Homo sapiens
gttcctgtctaggaa

SEQ ID NO: 41373 - DNA, 15 bp, Homo sapiens
agttcctgtctagga

SEQ ID NO: 41374 - DNA, 15 bp, Homo sapiens
tagttcctgtctagg

SEQ ID NO: 41375 - DNA, 15 bp, Homo sapiens
atagttcctgtctag

SEQ ID NO: 41376 - DNA, 15 bp, Homo sapiens
aatagttcctgtcta

SEQ ID NO: 41377 - DNA, 15 bp, Homo sapiens
aaatagttcctgtct

SEQ ID NO: 41378 - DNA, 15 bp, Homo sapiens
aaaatagttcctgtc

SEQ ID NO: 41379 - DNA, 15 bp, Homo sapiens
caaaatagttcctgt

SEQ ID NO: 41380 - DNA, 15 bp, Homo sapiens
acaaaatagttcctg

SEQ ID NO: 41381 - DNA, 15 bp, Homo sapiens
aacaaaatagttcct

SEQ ID NO: 41382 - DNA, 15 bp, Homo sapiens
gaacaaaatagttcc

SEQ ID NO: 41383 - DNA, 15 bp, Homo sapiens
ggaacaaaatagttc

SEQ ID NO: 41384 - DNA, 15 bp, Homo sapiens
aggaacaaaatagtt

SEQ ID NO: 41385 - DNA, 15 bp, Homo sapiens
taggaacaaaatagt

SEQ ID NO: 41386 - DNA, 15 bp, Homo sapiens
ctaggaacaaaatag

SEQ ID NO: 41387 - DNA, 15 bp, Homo sapiens
actaggaacaaaata

SEQ ID NO: 41388 - DNA, 15 bp, Homo sapiens
aactaggaacaaaat

SEQ ID NO: 41389 - DNA, 15 bp, Homo sapiens
taactaggaacaaaa

SEQ ID NO: 41390 - DNA, 15 bp, Homo sapiens
ctaactaggaacaaa

SEQ ID NO: 41391 - DNA, 15 bp, Homo sapiens
tctaactaggaacaa

SEQ ID NO: 41392 - DNA, 15 bp, Homo sapiens
ttctaactaggaaca

SEQ ID NO: 41393 - DNA, 15 bp, Homo sapiens
tttctaactaggaac

SEQ ID NO: 41394 - DNA, 15 bp, Homo sapiens
atttctaactaggaa

SEQ ID NO: 41395 - DNA, 15 bp, Homo sapiens
catttctaactagga

SEQ ID NO: 41396 - DNA, 15 bp, Homo sapiens
acatttctaactagg

SEQ ID NO: 41397 - DNA, 15 bp, Homo sapiens
aacatttctaactag

SEQ ID NO: 41398 - DNA, 15 bp, Homo sapiens
aaacatttctaacta

SEQ ID NO: 41399 - DNA, 15 bp, Homo sapiens
taaacatttctaact

SEQ ID NO: 41400 - DNA, 15 bp, Homo sapiens
ttaaacatttctaac

SEQ ID NO: 41401 - DNA, 15 bp, Homo sapiens
attaaacatttctaa

SEQ ID NO: 41402 - DNA, 15 bp, Homo sapiens
cattaaacatttcta

SEQ ID NO: 41403 - DNA, 15 bp, Homo sapiens
tcattaaacatttct

SEQ ID NO: 41404 - DNA, 15 bp, Homo sapiens
atcattaaacatttc

SEQ ID NO: 41405 - DNA, 15 bp, Homo sapiens
aatcattaaacattt

SEQ ID NO: 41406 - DNA, 15 bp, Homo sapiens
gaatcattaaacatt

SEQ ID NO: 41407 - DNA, 15 bp, Homo sapiens
tgaatcattaaacat

SEQ ID NO: 41408 - DNA, 15 bp, Homo sapiens
ctgaatcattaaaca

SEQ ID NO: 41409 - DNA, 15 bp, Homo sapiens
cctgaatcattaaac

SEQ ID NO: 41410 - DNA, 15 bp, Homo sapiens
ccctgaatcattaaa

SEQ ID NO: 41411 - DNA, 15 bp, Homo sapiens
tccctgaatcattaa

SEQ ID NO: 41412 - DNA, 15 bp, Homo sapiens
ttccctgaatcatta

SEQ ID NO: 41413 - DNA, 15 bp, Homo sapiens
tttccctgaatcatt

SEQ ID NO: 41414 - DNA, 15 bp, Homo sapiens
ttttccctgaatcat

SEQ ID NO: 41415 - DNA, 15 bp, Homo sapiens
attttccctgaatca

SEQ ID NO: 41416 - DNA, 15 bp, Homo sapiens
aattttccctgaatc

SEQ ID NO: 41417 - DNA, 15 bp, Homo sapiens
caattttccctgaat

SEQ ID NO: 41418 - DNA, 15 bp, Homo sapiens
tcaattttccctgaa

SEQ ID NO: 41419 - DNA, 15 bp, Homo sapiens
gtcaattttccctga

SEQ ID NO: 41420 - DNA, 15 bp, Homo sapiens
tgtcaattttccctg

SEQ ID NO: 41421 - DNA, 15 bp, Homo sapiens
ctgtcaattttccct

SEQ ID NO: 41422 - DNA, 15 bp, Homo sapiens
gctgtcaattttccc

SEQ ID NO: 41423 - DNA, 15 bp, Homo sapiens
agctgtcaattttcc

SEQ ID NO: 41424 - DNA, 15 bp, Homo sapiens
cagctgtcaattttc

SEQ ID NO: 41425 - DNA, 15 bp, Homo sapiens
tcagctgtcaatttt

SEQ ID NO: 41426 - DNA, 15 bp, Homo sapiens
ttcagctgtcaattt

SEQ ID NO: 41427 - DNA, 15 bp, Homo sapiens
attcagctgtcaatt

SEQ ID NO: 41428 - DNA, 15 bp, Homo sapiens
cattcagctgtcaat

SEQ ID NO: 41429 - DNA, 15 bp, Homo sapiens
ccattcagctgtcaa

SEQ ID NO: 41430 - DNA, 15 bp, Homo sapiens
cccattcagctgtca

SEQ ID NO: 41431 - DNA, 15 bp, Homo sapiens
tcccattcagctgtc

SEQ ID NO: 41432 - DNA, 15 bp, Homo sapiens
ctcccattcagctgt

SEQ ID NO: 41433 - DNA, 15 bp, Homo sapiens
actcccattcagctg

SEQ ID NO: 41434 - DNA, 15 bp, Homo sapiens
cactcccattcagct

SEQ ID NO: 41435 - DNA, 15 bp, Homo sapiens
tcactcccattcagc

SEQ ID NO: 41436 - DNA, 15 bp, Homo sapiens
gtcactcccattcag

SEQ ID NO: 41437 - DNA, 15 bp, Homo sapiens
tgtcactcccattca

SEQ ID NO: 41438 - DNA, 15 bp, Homo sapiens
atgtcactcccattc

SEQ ID NO: 41439 - DNA, 15 bp, Homo sapiens
tatgtcactcccatt

SEQ ID NO: 41440 - DNA, 15 bp, Homo sapiens
atatgtcactcccat

SEQ ID NO: 41441 - DNA, 15 bp, Homo sapiens
tatatgtcactccca

SEQ ID NO: 41442 - DNA, 15 bp, Homo sapiens
ttatatgtcactccc

SEQ ID NO: 41443 - DNA, 15 bp, Homo sapiens
attatatgtcactcc

SEQ ID NO: 41444 - DNA, 15 bp, Homo sapiens
aattatatgtcactc

SEQ ID NO: 41445 - DNA, 15 bp, Homo sapiens
gaattatatgtcact

SEQ ID NO: 41446 - DNA, 15 bp, Homo sapiens
tgaattatatgtcac

SEQ ID NO: 41447 - DNA, 15 bp, Homo sapiens
atgaattatatgtca

SEQ ID NO: 41448 - DNA, 15 bp, Homo sapiens
tatgaattatatgtc

SEQ ID NO: 41449 - DNA, 15 bp, Homo sapiens
gtatgaattatatgt

SEQ ID NO: 41450 - DNA, 15 bp, Homo sapiens
agtatgaattatatg

SEQ ID NO: 41451 - DNA, 15 bp, Homo sapiens
cagtatgaattatat

SEQ ID NO: 41452 - DNA, 15 bp, Homo sapiens
tcagtatgaattata

SEQ ID NO: 41453 - DNA, 15 bp, Homo sapiens
atcagtatgaattat

SEQ ID NO: 41454 - DNA, 15 bp, Homo sapiens
tatcagtatgaatta

SEQ ID NO: 41455 - DNA, 15 bp, Homo sapiens
atatcagtatgaatt

SEQ ID NO: 41456 - DNA, 15 bp, Homo sapiens
tatatcagtatgaat

SEQ ID NO: 41457 - DNA, 15 bp, Homo sapiens
atatatcagtatgaa

SEQ ID NO: 41458 - DNA, 15 bp, Homo sapiens
catatatcagtatga

SEQ ID NO: 41459 - DNA, 15 bp, Homo sapiens
tcatatatcagtatg

SEQ ID NO: 41460 - DNA, 15 bp, Homo sapiens
ctcatatatcagtat

SEQ ID NO: 41461 - DNA, 15 bp, Homo sapiens
tctcatatatcagta

SEQ ID NO: 41462 - DNA, 15 bp, Homo sapiens
ttctcatatatcagt

SEQ ID NO: 41463 - DNA, 15 bp, Homo sapiens
attctcatatatcag

SEQ ID NO: 41464 - DNA, 15 bp, Homo sapiens
tattctcatatatca

SEQ ID NO: 41465 - DNA, 15 bp, Homo sapiens
gtattctcatatatc

SEQ ID NO: 41466 - DNA, 15 bp, Homo sapiens
ggtattctcatatat

SEQ ID NO: 41467 - DNA, 15 bp, Homo sapiens
tggtattctcatata

SEQ ID NO: 41468 - DNA, 15 bp, Homo sapiens
ttggtattctcatat

SEQ ID NO: 41469 - DNA, 15 bp, Homo sapiens
attggtattctcata

SEQ ID NO: 41470 - DNA, 15 bp, Homo sapiens
cattggtattctcat

SEQ ID NO: 41471 - DNA, 15 bp, Homo sapiens
ccattggtattctca

SEQ ID NO: 41472 - DNA, 15 bp, Homo sapiens
accattggtattctc

SEQ ID NO: 41473 - DNA, 15 bp, Homo sapiens
caccattggtattct

SEQ ID NO: 41474 - DNA, 15 bp, Homo sapiens
ccaccattggtattc

SEQ ID NO: 41475 - DNA, 15 bp, Homo sapiens
gccaccattggtatt

SEQ ID NO: 41476 - DNA, 15 bp, Homo sapiens
ggccaccattggtat

SEQ ID NO: 41477 - DNA, 15 bp, Homo sapiens
aggccaccattggta

SEQ ID NO: 41478 - DNA, 15 bp, Homo sapiens
aaggccaccattggt

SEQ ID NO: 41479 - DNA, 15 bp, Homo sapiens
taaggccaccattgg

SEQ ID NO: 41480 - DNA, 15 bp, Homo sapiens
ctaaggccaccattg

SEQ ID NO: 41481 - DNA, 15 bp, Homo sapiens
cctaaggccaccatt

SEQ ID NO: 41482 - DNA, 15 bp, Homo sapiens
gcctaaggccaccat

SEQ ID NO: 41483 - DNA, 15 bp, Homo sapiens
ggcctaaggccacca

SEQ ID NO: 41484 - DNA, 15 bp, Homo sapiens
tggcctaaggccacc

SEQ ID NO: 41485 - DNA, 15 bp, Homo sapiens
ttggcctaaggccac

SEQ ID NO: 41486 - DNA, 15 bp, Homo sapiens
attggcctaaggcca

SEQ ID NO: 41487 - DNA, 15 bp, Homo sapiens
gattggcctaaggcc

SEQ ID NO: 41488 - DNA, 15 bp, Homo sapiens
ggattggcctaaggc

SEQ ID NO: 41489 - DNA, 15 bp, Homo sapiens
aggattggcctaagg

SEQ ID NO: 41490 - DNA, 15 bp, Homo sapiens
taggattggcctaag

SEQ ID NO: 41491 - DNA, 15 bp, Homo sapiens
ttaggattggcctaa

SEQ ID NO: 41492 - DNA, 15 bp, Homo sapiens
gttaggattggccta

SEQ ID NO: 41493 - DNA, 15 bp, Homo sapiens
tgttaggattggcct

SEQ ID NO: 41494 - DNA, 15 bp, Homo sapiens
ttgttaggattggcc

SEQ ID NO: 41495 - DNA, 15 bp, Homo sapiens
tttgttaggattggc

SEQ ID NO: 41496 - DNA, 15 bp, Homo sapiens
gtttgttaggattgg

SEQ ID NO: 41497 - DNA, 15 bp, Homo sapiens
tgtttgttaggattg

SEQ ID NO: 41498 - DNA, 15 bp, Homo sapiens
atgtttgttaggatt

SEQ ID NO: 41499 - DNA, 15 bp, Homo sapiens
gatgtttgttaggat

SEQ ID NO: 41500 - DNA, 15 bp, Homo sapiens
tgatgtttgttagga

SEQ ID NO: 41501 - DNA, 15 bp, Homo sapiens
ctgatgtttgttagg

SEQ ID NO: 41502 - DNA, 15 bp, Homo sapiens
cctgatgtttgttag

SEQ ID NO: 41503 - DNA, 15 bp, Homo sapiens
gcctgatgtttgtta

SEQ ID NO: 41504 - DNA, 15 bp, Homo sapiens
tgcctgatgtttgtt

SEQ ID NO: 41505 - DNA, 15 bp, Homo sapiens
ctgcctgatgtttgt

SEQ ID NO: 41506 - DNA, 15 bp, Homo sapiens
tctgcctgatgtttg

SEQ ID NO: 41507 - DNA, 15 bp, Homo sapiens
gtctgcctgatgttt

SEQ ID NO: 41508 - DNA, 15 bp, Homo sapiens
tgtctgcctgatgtt

SEQ ID NO: 41509 - DNA, 15 bp, Homo sapiens
ttgtctgcctgatgt

SEQ ID NO: 41510 - DNA, 15 bp, Homo sapiens
tttgtctgcctgatg

SEQ ID NO: 41511 - DNA, 15 bp, Homo sapiens
ttttgtctgcctgat

SEQ ID NO: 41512 - DNA, 15 bp, Homo sapiens
tttttgtctgcctga

SEQ ID NO: 41513 - DNA, 15 bp, Homo sapiens
gtttttgtctgcctg

SEQ ID NO: 41514 - DNA, 15 bp, Homo sapiens
ggtttttgtctgcct

SEQ ID NO: 41515 - DNA, 15 bp, Homo sapiens
tggtttttgtctgcc

SEQ ID NO: 41516 - DNA, 15 bp, Homo sapiens
ttggtttttgtctgc

SEQ ID NO: 41517 - DNA, 15 bp, Homo sapiens
cttggtttttgtctg

SEQ ID NO: 41518 - DNA, 15 bp, Homo sapiens
ccttggtttttgtct

SEQ ID NO: 41519 - DNA, 15 bp, Homo sapiens
tccttggtttttgtc

SEQ ID NO: 41520 - DNA, 15 bp, Homo sapiens
ttccttggtttttgt

SEQ ID NO: 41521 - DNA, 15 bp, Homo sapiens
cttccttggtttttg

SEQ ID NO: 41522 - DNA, 15 bp, Homo sapiens
gcttccttggttttt

SEQ ID NO: 41523 - DNA, 15 bp, Homo sapiens
tgcttccttggtttt

SEQ ID NO: 41524 - DNA, 15 bp, Homo sapiens
gtgcttccttggttt

SEQ ID NO: 41525 - DNA, 15 bp, Homo sapiens
tgtgcttccttggtt

SEQ ID NO: 41526 - DNA, 15 bp, Homo sapiens
gtgtgcttccttggt

SEQ ID NO: 41527 - DNA, 15 bp, Homo sapiens
ggtgtgcttccttgg

SEQ ID NO: 41528 - DNA, 15 bp, Homo sapiens
tggtgtgcttccttg

SEQ ID NO: 41529 - DNA, 15 bp, Homo sapiens
ttggtgtgcttcctt

SEQ ID NO: 41530 - DNA, 15 bp, Homo sapiens
tttggtgtgcttcct

SEQ ID NO: 41531 - DNA, 15 bp, Homo sapiens
gtttggtgtgcttcc

SEQ ID NO: 41532 - DNA, 15 bp, Homo sapiens
ggtttggtgtgcttc

SEQ ID NO: 41533 - DNA, 15 bp, Homo sapiens
aggtttggtgtgctt

SEQ ID NO: 41534 - DNA, 15 bp, Homo sapiens
gaggtttggtgtgct

SEQ ID NO: 41535 - DNA, 15 bp, Homo sapiens
agaggtttggtgtgc

SEQ ID NO: 41536 - DNA, 15 bp, Homo sapiens
aagaggtttggtgtg

SEQ ID NO: 41537 - DNA, 15 bp, Homo sapiens
taagaggtttggtgt

SEQ ID NO: 41538 - DNA, 15 bp, Homo sapiens
ttaagaggtttggtg

SEQ ID NO: 41539 - DNA, 15 bp, Homo sapiens
tttaagaggtttggt

SEQ ID NO: 41540 - DNA, 15 bp, Homo sapiens
ctttaagaggtttgg

SEQ ID NO: 41541 - DNA, 15 bp, Homo sapiens
gctttaagaggtttg

SEQ ID NO: 41542 - DNA, 15 bp, Homo sapiens
agctttaagaggttt

SEQ ID NO: 41543 - DNA, 15 bp, Homo sapiens
tagctttaagaggtt

SEQ ID NO: 41544 - DNA, 15 bp, Homo sapiens
atagctttaagaggt

SEQ ID NO: 41545 - DNA, 15 bp, Homo sapiens
catagctttaagagg

SEQ ID NO: 41546 - DNA, 15 bp, Homo sapiens
ccatagctttaagag

SEQ ID NO: 41547 - DNA, 15 bp, Homo sapiens
accatagctttaaga

SEQ ID NO: 41548 - DNA, 15 bp, Homo sapiens
aagaaaaaaaatgca

SEQ ID NO: 41549 - DNA, 15 bp, Homo sapiens
aaaaaaaaaaaaagc

SEQ ID NO: 41550 - DNA, 15 bp, Homo sapiens
cgcctggctaatttt

SEQ ID NO: 41551 - DNA, 15 bp, Homo sapiens
acgcctggctaattt

SEQ ID NO: 41552 - DNA, 15 bp, Homo sapiens
cacgcctggctaatt

SEQ ID NO: 41553 - DNA, 15 bp, Homo sapiens
accacgcctggctaa

SEQ ID NO: 41554 - DNA, 15 bp, Homo sapiens
caccacgcctggcta

SEQ ID NO: 41555 - DNA, 15 bp, Homo sapiens
ccaccacgcctggct

SEQ ID NO: 41556 - DNA, 15 bp, Homo sapiens
aaaatacaaaaaatt

SEQ ID NO: 41557 - DNA, 15 bp, Homo sapiens
aaaaatacaaaaaat

SEQ ID NO: 41558 - DNA, 15 bp, Homo sapiens
taaaaatacaaaaaa

SEQ ID NO: 41559 - DNA, 15 bp, Homo sapiens
caacatggagaaacc

SEQ ID NO: 41560 - DNA, 15 bp, Homo sapiens
ctttgggaagctgag

SEQ ID NO: 41561 - DNA, 15 bp, Homo sapiens
actttgggaagctga

SEQ ID NO: 41562 - DNA, 15 bp, Homo sapiens
cactttgggaagctg

SEQ ID NO: 41563 - DNA, 15 bp, Homo sapiens
gggaagattgcttga

SEQ ID NO: 41564 - DNA, 15 bp, Homo sapiens
gaaaaaaaaaaaaag

SEQ ID NO: 41565 - DNA, 15 bp, Homo sapiens
ctgagacaggagaat

SEQ ID NO: 41566 - DNA, 15 bp, Homo sapiens
gctgagacaggagaa

SEQ ID NO: 41567 - DNA, 15 bp, Homo sapiens
ggtcaggagttcaag

SEQ ID NO: 41568 - DNA, 15 bp, Homo sapiens
agtggctcacacctg

SEQ ID NO: 41569 - DNA, 15 bp, Homo sapiens
cagtggctcacacct

SEQ ID NO: 41570 - DNA, 15 bp, Homo sapiens
gcagtggctcacacc

SEQ ID NO: 41571 - DNA, 15 bp, Homo sapiens
aggtgtggtggcgca

SEQ ID NO: 41572 - DNA, 15 bp, Homo sapiens
caggtgtggtggcgc

SEQ ID NO: 41573 - DNA, 15 bp, Homo sapiens
ccaggtgtggtggcg

SEQ ID NO: 41574 - DNA, 15 bp, Homo sapiens
gccaggtgtggtggc

SEQ ID NO: 41575 - DNA, 15 bp, Homo sapiens
agccaggtgtggtgg

SEQ ID NO: 41576 - DNA, 15 bp, Homo sapiens
tagccaggtgtggtg

SEQ ID NO: 41577 - DNA, 15 bp, Homo sapiens
ttagccaggtgtggt

SEQ ID NO: 41578 - DNA, 15 bp, Homo sapiens
attagccaggtgtgg

SEQ ID NO: 41579 - DNA, 15 bp, Homo sapiens
aattagccaggtgtg

SEQ ID NO: 41580 - DNA, 15 bp, Homo sapiens
aaattagccaggtgt

SEQ ID NO: 41581 - DNA, 15 bp, Homo sapiens
aaaattagccaggtg

SEQ ID NO: 41582 - DNA, 15 bp, Homo sapiens
gctgggtgtggtggt

SEQ ID NO: 41583 - DNA, 15 bp, Homo sapiens
aattccagcactttg

SEQ ID NO: 41584 - DNA, 15 bp, Homo sapiens
taattccagcacttt

SEQ ID NO: 41585 - DNA, 15 bp, Homo sapiens
gtaattccagcactt

SEQ ID NO: 41586 - DNA, 15 bp, Homo sapiens
tgtaattccagcact

SEQ ID NO: 41587 - DNA, 15 bp, Homo sapiens
ctgtaattccagcac

SEQ ID NO: 41588 - DNA, 15 bp, Homo sapiens
cctgtaattccagca

SEQ ID NO: 41589 - DNA, 15 bp, Homo sapiens
gcctgggcaacagag

SEQ ID NO: 41590 - DNA, 15 bp, Homo sapiens
agcctgggcaacaga

SEQ ID NO: 41591 - DNA, 15 bp, Homo sapiens
cccaacactttggga

SEQ ID NO: 41592 - DNA, 15 bp, Homo sapiens
gtaatcccaacactt

SEQ ID NO: 41593 - DNA, 15 bp, Homo sapiens
tgtaatcccaacact

SEQ ID NO: 41594 - DNA, 15 bp, Homo sapiens
ctgtaatcccaacac

SEQ ID NO: 41595 - DNA, 15 bp, Homo sapiens
cctgtaatcccaaca

SEQ ID NO: 41596 - DNA, 15 bp, Homo sapiens
acctgtaatcccaac

SEQ ID NO: 41597 - DNA, 15 bp, Homo sapiens
cacctgtaatcccaa

SEQ ID NO: 41598 - DNA, 15 bp, Homo sapiens
cctgggcaacagagt

SEQ ID NO: 41599 - DNA, 15 bp, Homo sapiens
gcagtgagccgagac

SEQ ID NO: 41600 - DNA, 15 bp, Homo sapiens
gaggctgaggcagaa

SEQ ID NO: 41601 - DNA, 15 bp, Homo sapiens
ggaggctgaggcaga

SEQ ID NO: 41602 - DNA, 15 bp, Homo sapiens
ttgagaccagcctga

SEQ ID NO: 41603 - DNA, 15 bp, Homo sapiens
ggtttgagaccagcc

SEQ ID NO: 41604 - DNA, 15 bp, Homo sapiens
gggtttgagaccagc

SEQ ID NO: 41605 - DNA, 15 bp, Homo sapiens
ggggtttgagaccag

SEQ ID NO: 41606 - DNA, 15 bp, Homo sapiens
cctgggcaacaagag

SEQ ID NO: 41607 - DNA, 15 bp, Homo sapiens
gcctgggcaacaaga

SEQ ID NO: 41608 - DNA, 15 bp, Homo sapiens
agcctgggcaacaag

SEQ ID NO: 41609 - DNA, 15 bp, Homo sapiens
acaggagaattgctt

SEQ ID NO: 41610 - DNA, 15 bp, Homo sapiens
gacaggagaattgct

SEQ ID NO: 41611 - DNA, 15 bp, Homo sapiens
agacaggagaattgc

SEQ ID NO: 41612 - DNA, 15 bp, Homo sapiens
gagacaggagaattg

SEQ ID NO: 41613 - DNA, 15 bp, Homo sapiens
tgagacaggagaatt

SEQ ID NO: 41614 - DNA, 15 bp, Homo sapiens
tgggcatggtggcac

SEQ ID NO: 41615 - DNA, 15 bp, Homo sapiens
ctgggcatggtggca

SEQ ID NO: 41616 - DNA, 15 bp, Homo sapiens
tgagaccagcctgac

SEQ ID NO: 41617 - DNA, 15 bp, Homo sapiens
ggctgaggcagaaga

SEQ ID NO: 41618 - DNA, 15 bp, Homo sapiens
aggctgaggcagaag

SEQ ID NO: 41619 - DNA, 15 bp, Homo sapiens
caacctctgcctcct

SEQ ID NO: 41620 - DNA, 15 bp, Homo sapiens
cgcctcaaaaaaaaa

SEQ ID NO: 41621 - DNA, 15 bp, Homo sapiens
ccgcctcaaaaaaaa

SEQ ID NO: 41622 - DNA, 15 bp, Homo sapiens
tccgcctcaaaaaaa

SEQ ID NO: 41623 - DNA, 15 bp, Homo sapiens
ctccgcctcaaaaaa

SEQ ID NO: 41624 - DNA, 15 bp, Homo sapiens
actccgcctcaaaaa

SEQ ID NO: 41625 - DNA, 15 bp, Homo sapiens
gaaattacaggcatg

SEQ ID NO: 41626 - DNA, 15 bp, Homo sapiens
tgaaattacaggcat

SEQ ID NO: 41627 - DNA, 15 bp, Homo sapiens
ctgaaattacaggca

SEQ ID NO: 41628 - DNA, 15 bp, Homo sapiens
tgcctgtaatttcag

SEQ ID NO: 41629 - DNA, 15 bp, Homo sapiens
atgcctgtaatttca

SEQ ID NO: 41630 - DNA, 15 bp, Homo sapiens
catgcctgtaatttc

SEQ ID NO: 41631 - DNA, 15 bp, Homo sapiens
cactacagcctgggc

SEQ ID NO: 41632 - DNA, 15 bp, Homo sapiens
gcactacagcctggg

SEQ ID NO: 41633 - DNA, 15 bp, Homo sapiens
tgcactacagcctgg

SEQ ID NO: 41634 - DNA, 15 bp, Homo sapiens
caatctggtgacaga

SEQ ID NO: 41635 - DNA, 15 bp, Homo sapiens
cgccatggcactcca

SEQ ID NO: 41636 - DNA, 15 bp, Homo sapiens
gcgccatggcactcc

SEQ ID NO: 41637 - DNA, 15 bp, Homo sapiens
ggagtgccatggcgc

SEQ ID NO: 41638 - DNA, 15 bp, Homo sapiens
tggagtgccatggcg

SEQ ID NO: 41639 - DNA, 15 bp, Homo sapiens
tttttgaggcggagt

SEQ ID NO: 41640 - DNA, 15 bp, Homo sapiens
ttttttgaggcggag

SEQ ID NO: 41641 - DNA, 15 bp, Homo sapiens
tttttttgaggcgga

SEQ ID NO: 41642 - DNA, 15 bp, Homo sapiens
ttttttttgaggcgg

SEQ ID NO: 41643 - DNA, 15 bp, Homo sapiens
tttttttttgaggcg

SEQ ID NO: 41644 - DNA, 15 bp, Homo sapiens
tctgtcaccagattg

SEQ ID NO: 41645 - DNA, 15 bp, Homo sapiens
gttctcctgcctcag

SEQ ID NO: 41646 - DNA, 15 bp, Homo sapiens
aaaattttttttttt

SEQ ID NO: 41647 - DNA, 15 bp, Homo sapiens
aaatttttttttttt

SEQ ID NO: 41648 - DNA, 15 bp, Homo sapiens
atttttttttttttg

SEQ ID NO: 41649 - DNA, 15 bp, Homo sapiens
ttttgaggcggagtc

SEQ ID NO: 41650 - DNA, 15 bp, Homo sapiens
tttgaggcggagtct

SEQ ID NO: 41651 - DNA, 15 bp, Homo sapiens
ttgaggcggagtctc

SEQ ID NO: 41652 - DNA, 15 bp, Homo sapiens
tgaggcggagtctcg

SEQ ID NO: 41653 - DNA, 15 bp, Homo sapiens
gaggcggagtctcgc

SEQ ID NO: 41654 - DNA, 15 bp, Homo sapiens
aggcggagtctcgct

SEQ ID NO: 41655 - DNA, 15 bp, Homo sapiens
ggcggagtctcgctc

SEQ ID NO: 41656 - DNA, 15 bp, Homo sapiens
gcggagtctcgctct

SEQ ID NO: 41657 - DNA, 15 bp, Homo sapiens
ctcgctctgttgccc

SEQ ID NO: 41658 - DNA, 15 bp, Homo sapiens
tcgctctgttgccca

SEQ ID NO: 41659 - DNA, 15 bp, Homo sapiens
cgctctgttgcccag

SEQ ID NO: 41660 - DNA, 15 bp, Homo sapiens
ctgttgcccaggcta

SEQ ID NO: 41661 - DNA, 15 bp, Homo sapiens
tgttgcccaggctat

SEQ ID NO: 41662 - DNA, 15 bp, Homo sapiens
gttgcccaggctata

SEQ ID NO: 41663 - DNA, 15 bp, Homo sapiens
ttgcccaggctatag

SEQ ID NO: 41664 - DNA, 15 bp, Homo sapiens
tgcccaggctatagt

SEQ ID NO: 41665 - DNA, 15 bp, Homo sapiens
gcccaggctatagtg

SEQ ID NO: 41666 - DNA, 15 bp, Homo sapiens
cccaggctatagtgt

SEQ ID NO: 41667 - DNA, 15 bp, Homo sapiens
ccaggctatagtgta

SEQ ID NO: 41668 - DNA, 15 bp, Homo sapiens
caggctatagtgtag

SEQ ID NO: 41669 - DNA, 15 bp, Homo sapiens
aggctatagtgtagt

SEQ ID NO: 41670 - DNA, 15 bp, Homo sapiens
ggctatagtgtagtg

SEQ ID NO: 41671 - DNA, 15 bp, Homo sapiens
gctatagtgtagtgc

SEQ ID NO: 41672 - DNA, 15 bp, Homo sapiens
ctatagtgtagtgct

SEQ ID NO: 41673 - DNA, 15 bp, Homo sapiens
tatagtgtagtgctg

SEQ ID NO: 41674 - DNA, 15 bp, Homo sapiens
atagtgtagtgctgt

SEQ ID NO: 41675 - DNA, 15 bp, Homo sapiens
tagtgtagtgctgtg

SEQ ID NO: 41676 - DNA, 15 bp, Homo sapiens
agtgtagtgctgtga

SEQ ID NO: 41677 - DNA, 15 bp, Homo sapiens
gtgtagtgctgtgat

SEQ ID NO: 41678 - DNA, 15 bp, Homo sapiens
tgtagtgctgtgatc

SEQ ID NO: 41679 - DNA, 15 bp, Homo sapiens
gtagtgctgtgatct

SEQ ID NO: 41680 - DNA, 15 bp, Homo sapiens
tagtgctgtgatctc

SEQ ID NO: 41681 - DNA, 15 bp, Homo sapiens
agtgctgtgatctca

SEQ ID NO: 41682 - DNA, 15 bp, Homo sapiens
gtgctgtgatctcag

SEQ ID NO: 41683 - DNA, 15 bp, Homo sapiens
tgctgtgatctcagc

SEQ ID NO: 41684 - DNA, 15 bp, Homo sapiens
gctgtgatctcagct

SEQ ID NO: 41685 - DNA, 15 bp, Homo sapiens
ctgtgatctcagctc

SEQ ID NO: 41686 - DNA, 15 bp, Homo sapiens
tgtgatctcagctca

SEQ ID NO: 41687 - DNA, 15 bp, Homo sapiens
cctctgcctcctgga

SEQ ID NO: 41688 - DNA, 15 bp, Homo sapiens
ctctgcctcctggat

SEQ ID NO: 41689 - DNA, 15 bp, Homo sapiens
tctgcctcctggatt

SEQ ID NO: 41690 - DNA, 15 bp, Homo sapiens
ctgcctcctggattc

SEQ ID NO: 41691 - DNA, 15 bp, Homo sapiens
tgcctcctggattca

SEQ ID NO: 41692 - DNA, 15 bp, Homo sapiens
gcctcctggattcaa

SEQ ID NO: 41693 - DNA, 15 bp, Homo sapiens
cctcctggattcaag

SEQ ID NO: 41694 - DNA, 15 bp, Homo sapiens
ctcctggattcaagc

SEQ ID NO: 41695 - DNA, 15 bp, Homo sapiens
tcctggattcaagct

SEQ ID NO: 41696 - DNA, 15 bp, Homo sapiens
cctggattcaagctg

SEQ ID NO: 41697 - DNA, 15 bp, Homo sapiens
ctggattcaagctgt

SEQ ID NO: 41698 - DNA, 15 bp, Homo sapiens
tggattcaagctgtt

SEQ ID NO: 41699 - DNA, 15 bp, Homo sapiens
ggattcaagctgttc

SEQ ID NO: 41700 - DNA, 15 bp, Homo sapiens
gattcaagctgttct

SEQ ID NO: 41701 - DNA, 15 bp, Homo sapiens
attcaagctgttctc

SEQ ID NO: 41702 - DNA, 15 bp, Homo sapiens
ttcaagctgttctcc

SEQ ID NO: 41703 - DNA, 15 bp, Homo sapiens
tcaagctgttctcct

SEQ ID NO: 41704 - DNA, 15 bp, Homo sapiens
caagctgttctcctg

SEQ ID NO: 41705 - DNA, 15 bp, Homo sapiens
aagctgttctcctgc

SEQ ID NO: 41706 - DNA, 15 bp, Homo sapiens
agctgttctcctgcc

SEQ ID NO: 41707 - DNA, 15 bp, Homo sapiens
gctgttctcctgcct

SEQ ID NO: 41708 - DNA, 15 bp, Homo sapiens
ctgttctcctgcctc

SEQ ID NO: 41709 - DNA, 15 bp, Homo sapiens
tgttctcctgcctca

SEQ ID NO: 41710 - DNA, 15 bp, Homo sapiens
ctcctgcctcagcca

SEQ ID NO: 41711 - DNA, 15 bp, Homo sapiens
tcctgcctcagccac

SEQ ID NO: 41712 - DNA, 15 bp, Homo sapiens
cctgcctcagccacc

SEQ ID NO: 41713 - DNA, 15 bp, Homo sapiens
ctgcctcagccacct

SEQ ID NO: 41714 - DNA, 15 bp, Homo sapiens
tgcctcagccacctg

SEQ ID NO: 41715 - DNA, 15 bp, Homo sapiens
gcctcagccacctga

SEQ ID NO: 41716 - DNA, 15 bp, Homo sapiens
cctcagccacctgag

SEQ ID NO: 41717 - DNA, 15 bp, Homo sapiens
ctcagccacctgagt

SEQ ID NO: 41718 - DNA, 15 bp, Homo sapiens
tcagccacctgagtg

SEQ ID NO: 41719 - DNA, 15 bp, Homo sapiens
cagccacctgagtgt

SEQ ID NO: 41720 - DNA, 15 bp, Homo sapiens
agccacctgagtgtc

SEQ ID NO: 41721 - DNA, 15 bp, Homo sapiens
gccacctgagtgtct

SEQ ID NO: 41722 - DNA, 15 bp, Homo sapiens
ccacctgagtgtctg

SEQ ID NO: 41723 - DNA, 15 bp, Homo sapiens
cacctgagtgtctgg

SEQ ID NO: 41724 - DNA, 15 bp, Homo sapiens
acctgagtgtctggg

SEQ ID NO: 41725 - DNA, 15 bp, Homo sapiens
cctgagtgtctggga

SEQ ID NO: 41726 - DNA, 15 bp, Homo sapiens
ctgagtgtctgggat

SEQ ID NO: 41727 - DNA, 15 bp, Homo sapiens
tgagtgtctgggatt

SEQ ID NO: 41728 - DNA, 15 bp, Homo sapiens
gagtgtctgggatta

SEQ ID NO: 41729 - DNA, 15 bp, Homo sapiens
agtgtctgggattat

SEQ ID NO: 41730 - DNA, 15 bp, Homo sapiens
gtgtctgggattata

SEQ ID NO: 41731 - DNA, 15 bp, Homo sapiens
tgtctgggattatag

SEQ ID NO: 41732 - DNA, 15 bp, Homo sapiens
gtctgggattatagg

SEQ ID NO: 41733 - DNA, 15 bp, Homo sapiens
tctgggattataggc

SEQ ID NO: 41734 - DNA, 15 bp, Homo sapiens
tgggattataggcgt

SEQ ID NO: 41735 - DNA, 15 bp, Homo sapiens
gggattataggcgtg

SEQ ID NO: 41736 - DNA, 15 bp, Homo sapiens
ggattataggcgtgc

SEQ ID NO: 41737 - DNA, 15 bp, Homo sapiens
gattataggcgtgcg

SEQ ID NO: 41738 - DNA, 15 bp, Homo sapiens
attataggcgtgcgc

SEQ ID NO: 41739 - DNA, 15 bp, Homo sapiens
ttataggcgtgcgcc

SEQ ID NO: 41740 - DNA, 15 bp, Homo sapiens
tataggcgtgcgcca

SEQ ID NO: 41741 - DNA, 15 bp, Homo sapiens
ataggcgtgcgccac

SEQ ID NO: 41742 - DNA, 15 bp, Homo sapiens
taggcgtgcgccacc

SEQ ID NO: 41743 - DNA, 15 bp, Homo sapiens
aggcgtgcgccacca

SEQ ID NO: 41744 - DNA, 15 bp, Homo sapiens
ggcgtgcgccaccat

SEQ ID NO: 41745 - DNA, 15 bp, Homo sapiens
gcgtgcgccaccatg

SEQ ID NO: 41746 - DNA, 15 bp, Homo sapiens
cgtgcgccaccatgc

SEQ ID NO: 41747 - DNA, 15 bp, Homo sapiens
gtgcgccaccatgcc

SEQ ID NO: 41748 - DNA, 15 bp, Homo sapiens
tgcgccaccatgccc

SEQ ID NO: 41749 - DNA, 15 bp, Homo sapiens
gcgccaccatgccca

SEQ ID NO: 41750 - DNA, 15 bp, Homo sapiens
cgccaccatgcccag

SEQ ID NO: 41751 - DNA, 15 bp, Homo sapiens
accatgcccagctta

SEQ ID NO: 41752 - DNA, 15 bp, Homo sapiens
ccatgcccagcttat

SEQ ID NO: 41753 - DNA, 15 bp, Homo sapiens
catgcccagcttatt

SEQ ID NO: 41754 - DNA, 15 bp, Homo sapiens
atgcccagcttattt

SEQ ID NO: 41755 - DNA, 15 bp, Homo sapiens
tgcccagcttatttt

SEQ ID NO: 41756 - DNA, 15 bp, Homo sapiens
gcccagcttattttt

SEQ ID NO: 41757 - DNA, 15 bp, Homo sapiens
cccagcttatttttg

SEQ ID NO: 41758 - DNA, 15 bp, Homo sapiens
ccagcttatttttgt

SEQ ID NO: 41759 - DNA, 15 bp, Homo sapiens
cagcttatttttgta

SEQ ID NO: 41760 - DNA, 15 bp, Homo sapiens
agcttatttttgtat

SEQ ID NO: 41761 - DNA, 15 bp, Homo sapiens
gcttatttttgtatt

SEQ ID NO: 41762 - DNA, 15 bp, Homo sapiens
cttatttttgtattt

SEQ ID NO: 41763 - DNA, 15 bp, Homo sapiens
ttatttttgtatttt

SEQ ID NO: 41764 - DNA, 15 bp, Homo sapiens
agacggggtttcact

SEQ ID NO: 41765 - DNA, 15 bp, Homo sapiens
gacggggtttcactg

SEQ ID NO: 41766 - DNA, 15 bp, Homo sapiens
acggggtttcactgt

SEQ ID NO: 41767 - DNA, 15 bp, Homo sapiens
cggggtttcactgtg

SEQ ID NO: 41768 - DNA, 15 bp, Homo sapiens
ggggtttcactgtgt

SEQ ID NO: 41769 - DNA, 15 bp, Homo sapiens
ggtttcactgtgttg

SEQ ID NO: 41770 - DNA, 15 bp, Homo sapiens
gtttcactgtgttgg

SEQ ID NO: 41771 - DNA, 15 bp, Homo sapiens
tttcactgtgttggt

SEQ ID NO: 41772 - DNA, 15 bp, Homo sapiens
ttcactgtgttggtc

SEQ ID NO: 41773 - DNA, 15 bp, Homo sapiens
tcactgtgttggtca

SEQ ID NO: 41774 - DNA, 15 bp, Homo sapiens
cactgtgttggtcag

SEQ ID NO: 41775 - DNA, 15 bp, Homo sapiens
actgtgttggtcagg

SEQ ID NO: 41776 - DNA, 15 bp, Homo sapiens
ctgtgttggtcaggc

SEQ ID NO: 41777 - DNA, 15 bp, Homo sapiens
tgtgttggtcaggct

SEQ ID NO: 41778 - DNA, 15 bp, Homo sapiens
tctcgaactcctgat

SEQ ID NO: 41779 - DNA, 15 bp, Homo sapiens
ctcgaactcctgatc

SEQ ID NO: 41780 - DNA, 15 bp, Homo sapiens
tcgaactcctgatct

SEQ ID NO: 41781 - DNA, 15 bp, Homo sapiens
cgaactcctgatctc

SEQ ID NO: 41782 - DNA, 15 bp, Homo sapiens
gaactcctgatctca

SEQ ID NO: 41783 - DNA, 15 bp, Homo sapiens
aactcctgatctcat

SEQ ID NO: 41784 - DNA, 15 bp, Homo sapiens
actcctgatctcatg

SEQ ID NO: 41785 - DNA, 15 bp, Homo sapiens
ctcctgatctcatga

SEQ ID NO: 41786 - DNA, 15 bp, Homo sapiens
tcctgatctcatgat

SEQ ID NO: 41787 - DNA, 15 bp, Homo sapiens
cctgatctcatgatc

SEQ ID NO: 41788 - DNA, 15 bp, Homo sapiens
ctgatctcatgatcc

SEQ ID NO: 41789 - DNA, 15 bp, Homo sapiens
tgatctcatgatccg

SEQ ID NO: 41790 - DNA, 15 bp, Homo sapiens
gatctcatgatccgc

SEQ ID NO: 41791 - DNA, 15 bp, Homo sapiens
atctcatgatccgcc

SEQ ID NO: 41792 - DNA, 15 bp, Homo sapiens
tctcatgatccgcct

SEQ ID NO: 41793 - DNA, 15 bp, Homo sapiens
ctcatgatccgcctg

SEQ ID NO: 41794 - DNA, 15 bp, Homo sapiens
tcatgatccgcctgc

SEQ ID NO: 41795 - DNA, 15 bp, Homo sapiens
catgatccgcctgcc

SEQ ID NO: 41796 - DNA, 15 bp, Homo sapiens
tgatccgcctgcctt

SEQ ID NO: 41797 - DNA, 15 bp, Homo sapiens
gatccgcctgccttg

SEQ ID NO: 41798 - DNA, 15 bp, Homo sapiens
atccgcctgccttgg

SEQ ID NO: 41799 - DNA, 15 bp, Homo sapiens
tccgcctgccttggc

SEQ ID NO: 41800 - DNA, 15 bp, Homo sapiens
ccgcctgccttggcc

SEQ ID NO: 41801 - DNA, 15 bp, Homo sapiens
gggattacaggcatt

SEQ ID NO: 41802 - DNA, 15 bp, Homo sapiens
ggattacaggcattt

SEQ ID NO: 41803 - DNA, 15 bp, Homo sapiens
gattacaggcattta

SEQ ID NO: 41804 - DNA, 15 bp, Homo sapiens
attacaggcatttaa

SEQ ID NO: 41805 - DNA, 15 bp, Homo sapiens
ttacaggcatttaaa

SEQ ID NO: 41806 - DNA, 15 bp, Homo sapiens
tacaggcatttaaaa

SEQ ID NO: 41807 - DNA, 15 bp, Homo sapiens
acaggcatttaaaaa

SEQ ID NO: 41808 - DNA, 15 bp, Homo sapiens
caggcatttaaaaac

SEQ ID NO: 41809 - DNA, 15 bp, Homo sapiens
aggcatttaaaaact

SEQ ID NO: 41810 - DNA, 15 bp, Homo sapiens
ggcatttaaaaactt

SEQ ID NO: 41811 - DNA, 15 bp, Homo sapiens
gcatttaaaaacttt

SEQ ID NO: 41812 - DNA, 15 bp, Homo sapiens
catttaaaaactttt

SEQ ID NO: 41813 - DNA, 15 bp, Homo sapiens
atttaaaaacttttt

SEQ ID NO: 41814 - DNA, 15 bp, Homo sapiens
tttaaaaacttttta

SEQ ID NO: 41815 - DNA, 15 bp, Homo sapiens
ttaaaaactttttag

SEQ ID NO: 41816 - DNA, 15 bp, Homo sapiens
taaaaactttttagg

SEQ ID NO: 41817 - DNA, 15 bp, Homo sapiens
aaaaactttttaggc

SEQ ID NO: 41818 - DNA, 15 bp, Homo sapiens
aaaactttttaggct

SEQ ID NO: 41819 - DNA, 15 bp, Homo sapiens
aaactttttaggctg

SEQ ID NO: 41820 - DNA, 15 bp, Homo sapiens
aactttttaggctgg

SEQ ID NO: 41821 - DNA, 15 bp, Homo sapiens
actttttaggctggt

SEQ ID NO: 41822 - DNA, 15 bp, Homo sapiens
ctttttaggctggtc

SEQ ID NO: 41823 - DNA, 15 bp, Homo sapiens
tttttaggctggtca

SEQ ID NO: 41824 - DNA, 15 bp, Homo sapiens
ttttaggctggtcac

SEQ ID NO: 41825 - DNA, 15 bp, Homo sapiens
tttaggctggtcacg

SEQ ID NO: 41826 - DNA, 15 bp, Homo sapiens
ttaggctggtcacgg

SEQ ID NO: 41827 - DNA, 15 bp, Homo sapiens
taggctggtcacggt

SEQ ID NO: 41828 - DNA, 15 bp, Homo sapiens
aggctggtcacggtg

SEQ ID NO: 41829 - DNA, 15 bp, Homo sapiens
ggctggtcacggtgg

SEQ ID NO: 41830 - DNA, 15 bp, Homo sapiens
gctggtcacggtggc

SEQ ID NO: 41831 - DNA, 15 bp, Homo sapiens
ctggtcacggtggct

SEQ ID NO: 41832 - DNA, 15 bp, Homo sapiens
tggtcacggtggctc

SEQ ID NO: 41833 - DNA, 15 bp, Homo sapiens
ggtcacggtggctca

SEQ ID NO: 41834 - DNA, 15 bp, Homo sapiens
gtcacggtggctcat

SEQ ID NO: 41835 - DNA, 15 bp, Homo sapiens
tcacggtggctcatg

SEQ ID NO: 41836 - DNA, 15 bp, Homo sapiens
ctcatgcctgtaatt

SEQ ID NO: 41837 - DNA, 15 bp, Homo sapiens
tcatgcctgtaattt

SEQ ID NO: 41838 - DNA, 15 bp, Homo sapiens
gcctgtaatttcagg

SEQ ID NO: 41839 - DNA, 15 bp, Homo sapiens
cctgtaatttcagga

SEQ ID NO: 41840 - DNA, 15 bp, Homo sapiens
ctgtaatttcaggac

SEQ ID NO: 41841 - DNA, 15 bp, Homo sapiens
tgtaatttcaggact

SEQ ID NO: 41842 - DNA, 15 bp, Homo sapiens
gtaatttcaggactt

SEQ ID NO: 41843 - DNA, 15 bp, Homo sapiens
taatttcaggacttt

SEQ ID NO: 41844 - DNA, 15 bp, Homo sapiens
aatttcaggactttg

SEQ ID NO: 41845 - DNA, 15 bp, Homo sapiens
atttcaggactttgg

SEQ ID NO: 41846 - DNA, 15 bp, Homo sapiens
tttcaggactttggg

SEQ ID NO: 41847 - DNA, 15 bp, Homo sapiens
ttcaggactttggga

SEQ ID NO: 41848 - DNA, 15 bp, Homo sapiens
tcaggactttgggag

SEQ ID NO: 41849 - DNA, 15 bp, Homo sapiens
caggactttgggagg

SEQ ID NO: 41850 - DNA, 15 bp, Homo sapiens
aggactttgggaggc

SEQ ID NO: 41851 - DNA, 15 bp, Homo sapiens
ggactttgggaggct

SEQ ID NO: 41852 - DNA, 15 bp, Homo sapiens
gactttgggaggctg

SEQ ID NO: 41853 - DNA, 15 bp, Homo sapiens
actttgggaggctgc

SEQ ID NO: 41854 - DNA, 15 bp, Homo sapiens
ctttgggaggctgcg

SEQ ID NO: 41855 - DNA, 15 bp, Homo sapiens
tttgggaggctgcgg

SEQ ID NO: 41856 - DNA, 15 bp, Homo sapiens
ttgggaggctgcggc

SEQ ID NO: 41857 - DNA, 15 bp, Homo sapiens
tgggaggctgcggca

SEQ ID NO: 41858 - DNA, 15 bp, Homo sapiens
gggaggctgcggcag

SEQ ID NO: 41859 - DNA, 15 bp, Homo sapiens
ggaggctgcggcagt

SEQ ID NO: 41860 - DNA, 15 bp, Homo sapiens
gaggctgcggcagta

SEQ ID NO: 41861 - DNA, 15 bp, Homo sapiens
aggctgcggcagtag

SEQ ID NO: 41862 - DNA, 15 bp, Homo sapiens
ggctgcggcagtagg

SEQ ID NO: 41863 - DNA, 15 bp, Homo sapiens
gctgcggcagtagga

SEQ ID NO: 41864 - DNA, 15 bp, Homo sapiens
ctgcggcagtaggat

SEQ ID NO: 41865 - DNA, 15 bp, Homo sapiens
tgcggcagtaggatc

SEQ ID NO: 41866 - DNA, 15 bp, Homo sapiens
gcggcagtaggatca

SEQ ID NO: 41867 - DNA, 15 bp, Homo sapiens
cggcagtaggatcac

SEQ ID NO: 41868 - DNA, 15 bp, Homo sapiens
ggcagtaggatcact

SEQ ID NO: 41869 - DNA, 15 bp, Homo sapiens
gcagtaggatcactt

SEQ ID NO: 41870 - DNA, 15 bp, Homo sapiens
cagtaggatcacttg

SEQ ID NO: 41871 - DNA, 15 bp, Homo sapiens
agtaggatcacttgt

SEQ ID NO: 41872 - DNA, 15 bp, Homo sapiens
gtaggatcacttgtg

SEQ ID NO: 41873 - DNA, 15 bp, Homo sapiens
taggatcacttgtgg

SEQ ID NO: 41874 - DNA, 15 bp, Homo sapiens
aggatcacttgtggc

SEQ ID NO: 41875 - DNA, 15 bp, Homo sapiens
ggatcacttgtggcc

SEQ ID NO: 41876 - DNA, 15 bp, Homo sapiens
gatcacttgtggcca

SEQ ID NO: 41877 - DNA, 15 bp, Homo sapiens
atcacttgtggccaa

SEQ ID NO: 41878 - DNA, 15 bp, Homo sapiens
tcacttgtggccaag

SEQ ID NO: 41879 - DNA, 15 bp, Homo sapiens
cacttgtggccaaga

SEQ ID NO: 41880 - DNA, 15 bp, Homo sapiens
acttgtggccaagag

SEQ ID NO: 41881 - DNA, 15 bp, Homo sapiens
cttgtggccaagagt

SEQ ID NO: 41882 - DNA, 15 bp, Homo sapiens
ttgtggccaagagtt

SEQ ID NO: 41883 - DNA, 15 bp, Homo sapiens
tgtggccaagagttt

SEQ ID NO: 41884 - DNA, 15 bp, Homo sapiens
gtggccaagagtttg

SEQ ID NO: 41885 - DNA, 15 bp, Homo sapiens
tggccaagagtttga

SEQ ID NO: 41886 - DNA, 15 bp, Homo sapiens
ggccaagagtttgag

SEQ ID NO: 41887 - DNA, 15 bp, Homo sapiens
gccaagagtttgaga

SEQ ID NO: 41888 - DNA, 15 bp, Homo sapiens
ccaagagtttgagag

SEQ ID NO: 41889 - DNA, 15 bp, Homo sapiens
caagagtttgagaga

SEQ ID NO: 41890 - DNA, 15 bp, Homo sapiens
aagagtttgagagag

SEQ ID NO: 41891 - DNA, 15 bp, Homo sapiens
agagtttgagagagc

SEQ ID NO: 41892 - DNA, 15 bp, Homo sapiens
gagtttgagagagca

SEQ ID NO: 41893 - DNA, 15 bp, Homo sapiens
agtttgagagagcag

SEQ ID NO: 41894 - DNA, 15 bp, Homo sapiens
gtttgagagagcagt

SEQ ID NO: 41895 - DNA, 15 bp, Homo sapiens
tttgagagagcagtt

SEQ ID NO: 41896 - DNA, 15 bp, Homo sapiens
ttgagagagcagtta

SEQ ID NO: 41897 - DNA, 15 bp, Homo sapiens
tgagagagcagttat

SEQ ID NO: 41898 - DNA, 15 bp, Homo sapiens
gagagagcagttata

SEQ ID NO: 41899 - DNA, 15 bp, Homo sapiens
agagagcagttatag

SEQ ID NO: 41900 - DNA, 15 bp, Homo sapiens
gagagcagttatagt

SEQ ID NO: 41901 - DNA, 15 bp, Homo sapiens
agagcagttatagtc

SEQ ID NO: 41902 - DNA, 15 bp, Homo sapiens
gagcagttatagtct

SEQ ID NO: 41903 - DNA, 15 bp, Homo sapiens
agcagttatagtctc

SEQ ID NO: 41904 - DNA, 15 bp, Homo sapiens
gcagttatagtctct

SEQ ID NO: 41905 - DNA, 15 bp, Homo sapiens
cagttatagtctcta

SEQ ID NO: 41906 - DNA, 15 bp, Homo sapiens
agttatagtctctat

SEQ ID NO: 41907 - DNA, 15 bp, Homo sapiens
gttatagtctctata

SEQ ID NO: 41908 - DNA, 15 bp, Homo sapiens
ttatagtctctataa

SEQ ID NO: 41909 - DNA, 15 bp, Homo sapiens
tatagtctctataat

SEQ ID NO: 41910 - DNA, 15 bp, Homo sapiens
atagtctctataatg

SEQ ID NO: 41911 - DNA, 15 bp, Homo sapiens
tagtctctataatga

SEQ ID NO: 41912 - DNA, 15 bp, Homo sapiens
agtctctataatgaa

SEQ ID NO: 41913 - DNA, 15 bp, Homo sapiens
gtctctataatgaaa

SEQ ID NO: 41914 - DNA, 15 bp, Homo sapiens
tctctataatgaaaa

SEQ ID NO: 41915 - DNA, 15 bp, Homo sapiens
ctctataatgaaaat

SEQ ID NO: 41916 - DNA, 15 bp, Homo sapiens
tctataatgaaaatc

SEQ ID NO: 41917 - DNA, 15 bp, Homo sapiens
ctataatgaaaatct

SEQ ID NO: 41918 - DNA, 15 bp, Homo sapiens
tataatgaaaatctt

SEQ ID NO: 41919 - DNA, 15 bp, Homo sapiens
ataatgaaaatcttt

SEQ ID NO: 41920 - DNA, 15 bp, Homo sapiens
taatgaaaatctttt

SEQ ID NO: 41921 - DNA, 15 bp, Homo sapiens
aatgaaaatcttttt

SEQ ID NO: 41922 - DNA, 15 bp, Homo sapiens
atgaaaatctttttt

SEQ ID NO: 41923 - DNA, 15 bp, Homo sapiens
tgaaaatcttttttt

SEQ ID NO: 41924 - DNA, 15 bp, Homo sapiens
gaaaatctttttttt

SEQ ID NO: 41925 - DNA, 15 bp, Homo sapiens
aaaatcttttttttt

SEQ ID NO: 41926 - DNA, 15 bp, Homo sapiens
aaatctttttttttt

SEQ ID NO: 41927 - DNA, 15 bp, Homo sapiens
aatcttttttttttt

SEQ ID NO: 41928 - DNA, 15 bp, Homo sapiens
ttttttttaaagaca

SEQ ID NO: 41929 - DNA, 15 bp, Homo sapiens
tttttttaaagacag

SEQ ID NO: 41930 - DNA, 15 bp, Homo sapiens
ttttttaaagacaga

SEQ ID NO: 41931 - DNA, 15 bp, Homo sapiens
tttttaaagacagag

SEQ ID NO: 41932 - DNA, 15 bp, Homo sapiens
ttttaaagacagagt

SEQ ID NO: 41933 - DNA, 15 bp, Homo sapiens
tttaaagacagagtt

SEQ ID NO: 41934 - DNA, 15 bp, Homo sapiens
ttaaagacagagttg

SEQ ID NO: 41935 - DNA, 15 bp, Homo sapiens
taaagacagagttgc

SEQ ID NO: 41936 - DNA, 15 bp, Homo sapiens
aaagacagagttgca

SEQ ID NO: 41937 - DNA, 15 bp, Homo sapiens
aagacagagttgcac

SEQ ID NO: 41938 - DNA, 15 bp, Homo sapiens
agacagagttgcact

SEQ ID NO: 41939 - DNA, 15 bp, Homo sapiens
gacagagttgcactc

SEQ ID NO: 41940 - DNA, 15 bp, Homo sapiens
acagagttgcactct

SEQ ID NO: 41941 - DNA, 15 bp, Homo sapiens
cagagttgcactctg

SEQ ID NO: 41942 - DNA, 15 bp, Homo sapiens
agagttgcactctgt

SEQ ID NO: 41943 - DNA, 15 bp, Homo sapiens
gagttgcactctgtg

SEQ ID NO: 41944 - DNA, 15 bp, Homo sapiens
agttgcactctgtgg

SEQ ID NO: 41945 - DNA, 15 bp, Homo sapiens
gttgcactctgtggc

SEQ ID NO: 41946 - DNA, 15 bp, Homo sapiens
ttgcactctgtggcc

SEQ ID NO: 41947 - DNA, 15 bp, Homo sapiens
tgcactctgtggccc

SEQ ID NO: 41948 - DNA, 15 bp, Homo sapiens
gcactctgtggccca

SEQ ID NO: 41949 - DNA, 15 bp, Homo sapiens
cactctgtggcccag

SEQ ID NO: 41950 - DNA, 15 bp, Homo sapiens
actctgtggcccagt

SEQ ID NO: 41951 - DNA, 15 bp, Homo sapiens
ctctgtggcccagtg

SEQ ID NO: 41952 - DNA, 15 bp, Homo sapiens
tctgtggcccagtgg

SEQ ID NO: 41953 - DNA, 15 bp, Homo sapiens
ctgtggcccagtggc

SEQ ID NO: 41954 - DNA, 15 bp, Homo sapiens
tgtggcccagtggcg

SEQ ID NO: 41955 - DNA, 15 bp, Homo sapiens
gtggcccagtggcgc

SEQ ID NO: 41956 - DNA, 15 bp, Homo sapiens
tggcccagtggcgcg

SEQ ID NO: 41957 - DNA, 15 bp, Homo sapiens
ggcccagtggcgcga

SEQ ID NO: 41958 - DNA, 15 bp, Homo sapiens
gcccagtggcgcgat

SEQ ID NO: 41959 - DNA, 15 bp, Homo sapiens
cccagtggcgcgatc

SEQ ID NO: 41960 - DNA, 15 bp, Homo sapiens
ccagtggcgcgatct

SEQ ID NO: 41961 - DNA, 15 bp, Homo sapiens
gcgatctcagctcag

SEQ ID NO: 41962 - DNA, 15 bp, Homo sapiens
cgatctcagctcagt

SEQ ID NO: 41963 - DNA, 15 bp, Homo sapiens
gatctcagctcagtg

SEQ ID NO: 41964 - DNA, 15 bp, Homo sapiens
atctcagctcagtgc

SEQ ID NO: 41965 - DNA, 15 bp, Homo sapiens
tctcagctcagtgca

SEQ ID NO: 41966 - DNA, 15 bp, Homo sapiens
ctcagctcagtgcag

SEQ ID NO: 41967 - DNA, 15 bp, Homo sapiens
tcagctcagtgcagc

SEQ ID NO: 41968 - DNA, 15 bp, Homo sapiens
cagctcagtgcagcc

SEQ ID NO: 41969 - DNA, 15 bp, Homo sapiens
agctcagtgcagcct

SEQ ID NO: 41970 - DNA, 15 bp, Homo sapiens
gctcagtgcagcctc

SEQ ID NO: 41971 - DNA, 15 bp, Homo sapiens
ctcagtgcagcctct

SEQ ID NO: 41972 - DNA, 15 bp, Homo sapiens
tcagtgcagcctctg

SEQ ID NO: 41973 - DNA, 15 bp, Homo sapiens
cagtgcagcctctgc

SEQ ID NO: 41974 - DNA, 15 bp, Homo sapiens
agtgcagcctctgct

SEQ ID NO: 41975 - DNA, 15 bp, Homo sapiens
gtgcagcctctgctt

SEQ ID NO: 41976 - DNA, 15 bp, Homo sapiens
tgcagcctctgcttc

SEQ ID NO: 41977 - DNA, 15 bp, Homo sapiens
gcagcctctgcttcc

SEQ ID NO: 41978 - DNA, 15 bp, Homo sapiens
cagcctctgcttccg

SEQ ID NO: 41979 - DNA, 15 bp, Homo sapiens
agcctctgcttccgg

SEQ ID NO: 41980 - DNA, 15 bp, Homo sapiens
gcctctgcttccggg

SEQ ID NO: 41981 - DNA, 15 bp, Homo sapiens
cctctgcttccgggg

SEQ ID NO: 41982 - DNA, 15 bp, Homo sapiens
ctctgcttccggggt

SEQ ID NO: 41983 - DNA, 15 bp, Homo sapiens
tctgcttccggggtt

SEQ ID NO: 41984 - DNA, 15 bp, Homo sapiens
ctgcttccggggttc

SEQ ID NO: 41985 - DNA, 15 bp, Homo sapiens
tgcttccggggttca

SEQ ID NO: 41986 - DNA, 15 bp, Homo sapiens
gcttccggggttcaa

SEQ ID NO: 41987 - DNA, 15 bp, Homo sapiens
cttccggggttcaag

SEQ ID NO: 41988 - DNA, 15 bp, Homo sapiens
ttccggggttcaagt

SEQ ID NO: 41989 - DNA, 15 bp, Homo sapiens
tccggggttcaagta

SEQ ID NO: 41990 - DNA, 15 bp, Homo sapiens
ccggggttcaagtaa

SEQ ID NO: 41991 - DNA, 15 bp, Homo sapiens
cggggttcaagtaat

SEQ ID NO: 41992 - DNA, 15 bp, Homo sapiens
ggggttcaagtaatt

SEQ ID NO: 41993 - DNA, 15 bp, Homo sapiens
gggttcaagtaattc

SEQ ID NO: 41994 - DNA, 15 bp, Homo sapiens
ggttcaagtaattct

SEQ ID NO: 41995 - DNA, 15 bp, Homo sapiens
gttcaagtaattctc

SEQ ID NO: 41996 - DNA, 15 bp, Homo sapiens
ttcaagtaattctca

SEQ ID NO: 41997 - DNA, 15 bp, Homo sapiens
tcaagtaattctcat

SEQ ID NO: 41998 - DNA, 15 bp, Homo sapiens
caagtaattctcatg

SEQ ID NO: 41999 - DNA, 15 bp, Homo sapiens
aagtaattctcatgc

SEQ ID NO: 42000 - DNA, 15 bp, Homo sapiens
agtaattctcatgcc

SEQ ID NO: 42001 - DNA, 15 bp, Homo sapiens
gtaattctcatgcct

SEQ ID NO: 42002 - DNA, 15 bp, Homo sapiens
taattctcatgcctc

SEQ ID NO: 42003 - DNA, 15 bp, Homo sapiens
aattctcatgcctca

SEQ ID NO: 42004 - DNA, 15 bp, Homo sapiens
attctcatgcctcag

SEQ ID NO: 42005 - DNA, 15 bp, Homo sapiens
ttctcatgcctcagc

SEQ ID NO: 42006 - DNA, 15 bp, Homo sapiens
tctcatgcctcagcc

SEQ ID NO: 42007 - DNA, 15 bp, Homo sapiens
ctcatgcctcagcct

SEQ ID NO: 42008 - DNA, 15 bp, Homo sapiens
tcatgcctcagcctc

SEQ ID NO: 42009 - DNA, 15 bp, Homo sapiens
catgcctcagcctcc

SEQ ID NO: 42010 - DNA, 15 bp, Homo sapiens
atgcctcagcctccc

SEQ ID NO: 42011 - DNA, 15 bp, Homo sapiens
gcctccctagtagct

SEQ ID NO: 42012 - DNA, 15 bp, Homo sapiens
cctccctagtagctg

SEQ ID NO: 42013 - DNA, 15 bp, Homo sapiens
ctccctagtagctga

SEQ ID NO: 42014 - DNA, 15 bp, Homo sapiens
tccctagtagctgaa

SEQ ID NO: 42015 - DNA, 15 bp, Homo sapiens
ccctagtagctgaaa

SEQ ID NO: 42016 - DNA, 15 bp, Homo sapiens
cctagtagctgaaat

SEQ ID NO: 42017 - DNA, 15 bp, Homo sapiens
ctagtagctgaaatt

SEQ ID NO: 42018 - DNA, 15 bp, Homo sapiens
tagtagctgaaatta

SEQ ID NO: 42019 - DNA, 15 bp, Homo sapiens
agtagctgaaattac

SEQ ID NO: 42020 - DNA, 15 bp, Homo sapiens
gtagctgaaattaca

SEQ ID NO: 42021 - DNA, 15 bp, Homo sapiens
tagctgaaattacag

SEQ ID NO: 42022 - DNA, 15 bp, Homo sapiens
agctgaaattacagg

SEQ ID NO: 42023 - DNA, 15 bp, Homo sapiens
gctgaaattacaggc

SEQ ID NO: 42024 - DNA, 15 bp, Homo sapiens
aaattacaggcatgc

SEQ ID NO: 42025 - DNA, 15 bp, Homo sapiens
aattacaggcatgca

SEQ ID NO: 42026 - DNA, 15 bp, Homo sapiens
tgcaccaccacacct

SEQ ID NO: 42027 - DNA, 15 bp, Homo sapiens
gcaccaccacacctg

SEQ ID NO: 42028 - DNA, 15 bp, Homo sapiens
caccaccacacctgg

SEQ ID NO: 42029 - DNA, 15 bp, Homo sapiens
accaccacacctggc

SEQ ID NO: 42030 - DNA, 15 bp, Homo sapiens
acacctggctaattg

SEQ ID NO: 42031 - DNA, 15 bp, Homo sapiens
cacctggctaattgt

SEQ ID NO: 42032 - DNA, 15 bp, Homo sapiens
acctggctaattgta

SEQ ID NO: 42033 - DNA, 15 bp, Homo sapiens
cctggctaattgtat

SEQ ID NO: 42034 - DNA, 15 bp, Homo sapiens
ctggctaattgtatt

SEQ ID NO: 42035 - DNA, 15 bp, Homo sapiens
tggctaattgtattt

SEQ ID NO: 42036 - DNA, 15 bp, Homo sapiens
ggctaattgtatttt

SEQ ID NO: 42037 - DNA, 15 bp, Homo sapiens
gctaattgtattttt

SEQ ID NO: 42038 - DNA, 15 bp, Homo sapiens
ctaattgtattttta

SEQ ID NO: 42039 - DNA, 15 bp, Homo sapiens
taattgtatttttag

SEQ ID NO: 42040 - DNA, 15 bp, Homo sapiens
aattgtatttttagt

SEQ ID NO: 42041 - DNA, 15 bp, Homo sapiens
attgtatttttagta

SEQ ID NO: 42042 - DNA, 15 bp, Homo sapiens
tttttagtagagata

SEQ ID NO: 42043 - DNA, 15 bp, Homo sapiens
tagagatagggtttt

SEQ ID NO: 42044 - DNA, 15 bp, Homo sapiens
agagatagggttttg

SEQ ID NO: 42045 - DNA, 15 bp, Homo sapiens
gagatagggttttgc

SEQ ID NO: 42046 - DNA, 15 bp, Homo sapiens
agatagggttttgcc

SEQ ID NO: 42047 - DNA, 15 bp, Homo sapiens
gatagggttttgcca

SEQ ID NO: 42048 - DNA, 15 bp, Homo sapiens
atagggttttgccat

SEQ ID NO: 42049 - DNA, 15 bp, Homo sapiens
tagggttttgccatg

SEQ ID NO: 42050 - DNA, 15 bp, Homo sapiens
agggttttgccatgt

SEQ ID NO: 42051 - DNA, 15 bp, Homo sapiens
gggttttgccatgtt

SEQ ID NO: 42052 - DNA, 15 bp, Homo sapiens
ggttttgccatgttg

SEQ ID NO: 42053 - DNA, 15 bp, Homo sapiens
gttttgccatgttgt

SEQ ID NO: 42054 - DNA, 15 bp, Homo sapiens
ttttgccatgttgtc

SEQ ID NO: 42055 - DNA, 15 bp, Homo sapiens
tttgccatgttgtcc

SEQ ID NO: 42056 - DNA, 15 bp, Homo sapiens
ttgccatgttgtcca

SEQ ID NO: 42057 - DNA, 15 bp, Homo sapiens
tgccatgttgtccag

SEQ ID NO: 42058 - DNA, 15 bp, Homo sapiens
gccatgttgtccagg

SEQ ID NO: 42059 - DNA, 15 bp, Homo sapiens
ccatgttgtccaggc

SEQ ID NO: 42060 - DNA, 15 bp, Homo sapiens
catgttgtccaggct

SEQ ID NO: 42061 - DNA, 15 bp, Homo sapiens
atgttgtccaggctg

SEQ ID NO: 42062 - DNA, 15 bp, Homo sapiens
caggctggtcttgac

SEQ ID NO: 42063 - DNA, 15 bp, Homo sapiens
aggctggtcttgacc

SEQ ID NO: 42064 - DNA, 15 bp, Homo sapiens
ggctggtcttgacct

SEQ ID NO: 42065 - DNA, 15 bp, Homo sapiens
gctggtcttgacctc

SEQ ID NO: 42066 - DNA, 15 bp, Homo sapiens
ctggtcttgacctcc

SEQ ID NO: 42067 - DNA, 15 bp, Homo sapiens
tggtcttgacctcct

SEQ ID NO: 42068 - DNA, 15 bp, Homo sapiens
ggtcttgacctcctg

SEQ ID NO: 42069 - DNA, 15 bp, Homo sapiens
gtcttgacctcctga

SEQ ID NO: 42070 - DNA, 15 bp, Homo sapiens
tcttgacctcctgac

SEQ ID NO: 42071 - DNA, 15 bp, Homo sapiens
cttgacctcctgacc

SEQ ID NO: 42072 - DNA, 15 bp, Homo sapiens
ttgacctcctgacct

SEQ ID NO: 42073 - DNA, 15 bp, Homo sapiens
tgacctcctgacctg

SEQ ID NO: 42074 - DNA, 15 bp, Homo sapiens
gacctcctgacctga

SEQ ID NO: 42075 - DNA, 15 bp, Homo sapiens
acctcctgacctgaa

SEQ ID NO: 42076 - DNA, 15 bp, Homo sapiens
cctcctgacctgaag

SEQ ID NO: 42077 - DNA, 15 bp, Homo sapiens
ctcctgacctgaagt

SEQ ID NO: 42078 - DNA, 15 bp, Homo sapiens
tcctgacctgaagtg

SEQ ID NO: 42079 - DNA, 15 bp, Homo sapiens
cctgacctgaagtga

SEQ ID NO: 42080 - DNA, 15 bp, Homo sapiens
ctgacctgaagtgat

SEQ ID NO: 42081 - DNA, 15 bp, Homo sapiens
tgacctgaagtgatc

SEQ ID NO: 42082 - DNA, 15 bp, Homo sapiens
gacctgaagtgatcg

SEQ ID NO: 42083 - DNA, 15 bp, Homo sapiens
acctgaagtgatcgc

SEQ ID NO: 42084 - DNA, 15 bp, Homo sapiens
cctgaagtgatcgcc

SEQ ID NO: 42085 - DNA, 15 bp, Homo sapiens
ctgaagtgatcgccc

SEQ ID NO: 42086 - DNA, 15 bp, Homo sapiens
tgaagtgatcgcccg

SEQ ID NO: 42087 - DNA, 15 bp, Homo sapiens
gaagtgatcgcccgc

SEQ ID NO: 42088 - DNA, 15 bp, Homo sapiens
aagtgatcgcccgcc

SEQ ID NO: 42089 - DNA, 15 bp, Homo sapiens
agtgatcgcccgcct

SEQ ID NO: 42090 - DNA, 15 bp, Homo sapiens
gtgatcgcccgcctc

SEQ ID NO: 42091 - DNA, 15 bp, Homo sapiens
tgatcgcccgcctca

SEQ ID NO: 42092 - DNA, 15 bp, Homo sapiens
gatcgcccgcctcaa

SEQ ID NO: 42093 - DNA, 15 bp, Homo sapiens
atcgcccgcctcaaa

SEQ ID NO: 42094 - DNA, 15 bp, Homo sapiens
tcgcccgcctcaaac

SEQ ID NO: 42095 - DNA, 15 bp, Homo sapiens
cgcccgcctcaaacc

SEQ ID NO: 42096 - DNA, 15 bp, Homo sapiens
gcccgcctcaaaccc

SEQ ID NO: 42097 - DNA, 15 bp, Homo sapiens
cccgcctcaaacccc

SEQ ID NO: 42098 - DNA, 15 bp, Homo sapiens
ccgcctcaaaccccc

SEQ ID NO: 42099 - DNA, 15 bp, Homo sapiens
cgcctcaaaccccca

SEQ ID NO: 42100 - DNA, 15 bp, Homo sapiens
gcctcaaacccccaa

SEQ ID NO: 42101 - DNA, 15 bp, Homo sapiens
cctcaaacccccaaa

SEQ ID NO: 42102 - DNA, 15 bp, Homo sapiens
ctcaaacccccaaag

SEQ ID NO: 42103 - DNA, 15 bp, Homo sapiens
tcaaacccccaaagt

SEQ ID NO: 42104 - DNA, 15 bp, Homo sapiens
caaacccccaaagtg

SEQ ID NO: 42105 - DNA, 15 bp, Homo sapiens
aaacccccaaagtgc

SEQ ID NO: 42106 - DNA, 15 bp, Homo sapiens
aacccccaaagtgct

SEQ ID NO: 42107 - DNA, 15 bp, Homo sapiens
acccccaaagtgctg

SEQ ID NO: 42108 - DNA, 15 bp, Homo sapiens
cccccaaagtgctgg

SEQ ID NO: 42109 - DNA, 15 bp, Homo sapiens
ccccaaagtgctggg

SEQ ID NO: 42110 - DNA, 15 bp, Homo sapiens
gggattacagacata

SEQ ID NO: 42111 - DNA, 15 bp, Homo sapiens
ggattacagacataa

SEQ ID NO: 42112 - DNA, 15 bp, Homo sapiens
gattacagacataag

SEQ ID NO: 42113 - DNA, 15 bp, Homo sapiens
attacagacataagt

SEQ ID NO: 42114 - DNA, 15 bp, Homo sapiens
ttacagacataagtc

SEQ ID NO: 42115 - DNA, 15 bp, Homo sapiens
tacagacataagtca

SEQ ID NO: 42116 - DNA, 15 bp, Homo sapiens
acagacataagtcat

SEQ ID NO: 42117 - DNA, 15 bp, Homo sapiens
cagacataagtcatc

SEQ ID NO: 42118 - DNA, 15 bp, Homo sapiens
agacataagtcatca

SEQ ID NO: 42119 - DNA, 15 bp, Homo sapiens
gacataagtcatcac

SEQ ID NO: 42120 - DNA, 15 bp, Homo sapiens
acataagtcatcaca

SEQ ID NO: 42121 - DNA, 15 bp, Homo sapiens
cataagtcatcacac

SEQ ID NO: 42122 - DNA, 15 bp, Homo sapiens
ataagtcatcacacc

SEQ ID NO: 42123 - DNA, 15 bp, Homo sapiens
taagtcatcacaccc

SEQ ID NO: 42124 - DNA, 15 bp, Homo sapiens
aagtcatcacaccca

SEQ ID NO: 42125 - DNA, 15 bp, Homo sapiens
agtcatcacacccag

SEQ ID NO: 42126 - DNA, 15 bp, Homo sapiens
gtcatcacacccagc

SEQ ID NO: 42127 - DNA, 15 bp, Homo sapiens
tcatcacacccagcc

SEQ ID NO: 42128 - DNA, 15 bp, Homo sapiens
catcacacccagcct

SEQ ID NO: 42129 - DNA, 15 bp, Homo sapiens
atcacacccagccta

SEQ ID NO: 42130 - DNA, 15 bp, Homo sapiens
tcacacccagcctat

SEQ ID NO: 42131 - DNA, 15 bp, Homo sapiens
cacacccagcctata

SEQ ID NO: 42132 - DNA, 15 bp, Homo sapiens
acacccagcctataa

SEQ ID NO: 42133 - DNA, 15 bp, Homo sapiens
cacccagcctataat

SEQ ID NO: 42134 - DNA, 15 bp, Homo sapiens
acccagcctataata

SEQ ID NO: 42135 - DNA, 15 bp, Homo sapiens
cccagcctataataa

SEQ ID NO: 42136 - DNA, 15 bp, Homo sapiens
ccagcctataataaa

SEQ ID NO: 42137 - DNA, 15 bp, Homo sapiens
cagcctataataaaa

SEQ ID NO: 42138 - DNA, 15 bp, Homo sapiens
agcctataataaaaa

SEQ ID NO: 42139 - DNA, 15 bp, Homo sapiens
gcctataataaaaaa

SEQ ID NO: 42140 - DNA, 15 bp, Homo sapiens
cctataataaaaaac

SEQ ID NO: 42141 - DNA, 15 bp, Homo sapiens
ctataataaaaaact

SEQ ID NO: 42142 - DNA, 15 bp, Homo sapiens
tataataaaaaactt

SEQ ID NO: 42143 - DNA, 15 bp, Homo sapiens
ataataaaaaacttt

SEQ ID NO: 42144 - DNA, 15 bp, Homo sapiens
taataaaaaacttta

SEQ ID NO: 42145 - DNA, 15 bp, Homo sapiens
aataaaaaactttaa

SEQ ID NO: 42146 - DNA, 15 bp, Homo sapiens
ataaaaaactttaaa

SEQ ID NO: 42147 - DNA, 15 bp, Homo sapiens
taaaaaactttaaaa

SEQ ID NO: 42148 - DNA, 15 bp, Homo sapiens
aaaaaactttaaaag

SEQ ID NO: 42149 - DNA, 15 bp, Homo sapiens
aaaaactttaaaagt

SEQ ID NO: 42150 - DNA, 15 bp, Homo sapiens
aaaactttaaaagtt

SEQ ID NO: 42151 - DNA, 15 bp, Homo sapiens
aaactttaaaagttt

SEQ ID NO: 42152 - DNA, 15 bp, Homo sapiens
aactttaaaagttta

SEQ ID NO: 42153 - DNA, 15 bp, Homo sapiens
actttaaaagtttaa

SEQ ID NO: 42154 - DNA, 15 bp, Homo sapiens
ctttaaaagtttaaa

SEQ ID NO: 42155 - DNA, 15 bp, Homo sapiens
tttaaaagtttaaaa

SEQ ID NO: 42156 - DNA, 15 bp, Homo sapiens
ttaaaagtttaaaaa

SEQ ID NO: 42157 - DNA, 15 bp, Homo sapiens
taaaagtttaaaaaa

SEQ ID NO: 42158 - DNA, 15 bp, Homo sapiens
aaaagtttaaaaaaa

SEQ ID NO: 42159 - DNA, 15 bp, Homo sapiens
aaagtttaaaaaaaa

SEQ ID NO: 42160 - DNA, 15 bp, Homo sapiens
aagtttaaaaaaaaa

SEQ ID NO: 42161 - DNA, 15 bp, Homo sapiens
agtttaaaaaaaaat

SEQ ID NO: 42162 - DNA, 15 bp, Homo sapiens
gtttaaaaaaaaatt

SEQ ID NO: 42163 - DNA, 15 bp, Homo sapiens
tttaaaaaaaaattt

SEQ ID NO: 42164 - DNA, 15 bp, Homo sapiens
ttaaaaaaaaattta

SEQ ID NO: 42165 - DNA, 15 bp, Homo sapiens
taaaaaaaaatttaa

SEQ ID NO: 42166 - DNA, 15 bp, Homo sapiens
aaaaaaaaatttaaa

SEQ ID NO: 42167 - DNA, 15 bp, Homo sapiens
aaaaaaaatttaaac

SEQ ID NO: 42168 - DNA, 15 bp, Homo sapiens
aaaaaaatttaaact

SEQ ID NO: 42169 - DNA, 15 bp, Homo sapiens
aaaaaatttaaactt

SEQ ID NO: 42170 - DNA, 15 bp, Homo sapiens
aaaaatttaaacttc

SEQ ID NO: 42171 - DNA, 15 bp, Homo sapiens
aaaatttaaacttca

SEQ ID NO: 42172 - DNA, 15 bp, Homo sapiens
aaatttaaacttcat

SEQ ID NO: 42173 - DNA, 15 bp, Homo sapiens
aatttaaacttcata

SEQ ID NO: 42174 - DNA, 15 bp, Homo sapiens
atttaaacttcatag

SEQ ID NO: 42175 - DNA, 15 bp, Homo sapiens
tttaaacttcataga

SEQ ID NO: 42176 - DNA, 15 bp, Homo sapiens
ttaaacttcatagag

SEQ ID NO: 42177 - DNA, 15 bp, Homo sapiens
taaacttcatagagg

SEQ ID NO: 42178 - DNA, 15 bp, Homo sapiens
aaacttcatagaggt

SEQ ID NO: 42179 - DNA, 15 bp, Homo sapiens
aacttcatagaggtt

SEQ ID NO: 42180 - DNA, 15 bp, Homo sapiens
acttcatagaggttc

SEQ ID NO: 42181 - DNA, 15 bp, Homo sapiens
cttcatagaggttct

SEQ ID NO: 42182 - DNA, 15 bp, Homo sapiens
ttcatagaggttctc

SEQ ID NO: 42183 - DNA, 15 bp, Homo sapiens
tcatagaggttctcg

SEQ ID NO: 42184 - DNA, 15 bp, Homo sapiens
catagaggttctcga

SEQ ID NO: 42185 - DNA, 15 bp, Homo sapiens
atagaggttctcgaa

SEQ ID NO: 42186 - DNA, 15 bp, Homo sapiens
tagaggttctcgaat

SEQ ID NO: 42187 - DNA, 15 bp, Homo sapiens
agaggttctcgaata

SEQ ID NO: 42188 - DNA, 15 bp, Homo sapiens
gaggttctcgaatat

SEQ ID NO: 42189 - DNA, 15 bp, Homo sapiens
aggttctcgaatatt

SEQ ID NO: 42190 - DNA, 15 bp, Homo sapiens
ggttctcgaatatta

SEQ ID NO: 42191 - DNA, 15 bp, Homo sapiens
gttctcgaatattat

SEQ ID NO: 42192 - DNA, 15 bp, Homo sapiens
ttctcgaatattatc

SEQ ID NO: 42193 - DNA, 15 bp, Homo sapiens
tctcgaatattatct

SEQ ID NO: 42194 - DNA, 15 bp, Homo sapiens
ctcgaatattatctt

SEQ ID NO: 42195 - DNA, 15 bp, Homo sapiens
tcgaatattatcttt

SEQ ID NO: 42196 - DNA, 15 bp, Homo sapiens
cgaatattatctttc

SEQ ID NO: 42197 - DNA, 15 bp, Homo sapiens
gaatattatctttct

SEQ ID NO: 42198 - DNA, 15 bp, Homo sapiens
aatattatctttctt

SEQ ID NO: 42199 - DNA, 15 bp, Homo sapiens
atattatctttcttt

SEQ ID NO: 42200 - DNA, 15 bp, Homo sapiens
tattatctttctttc

SEQ ID NO: 42201 - DNA, 15 bp, Homo sapiens
attatctttctttca

SEQ ID NO: 42202 - DNA, 15 bp, Homo sapiens
ttatctttctttcat

SEQ ID NO: 42203 - DNA, 15 bp, Homo sapiens
tatctttctttcatt

SEQ ID NO: 42204 - DNA, 15 bp, Homo sapiens
atctttctttcatta

SEQ ID NO: 42205 - DNA, 15 bp, Homo sapiens
tctttctttcattaa

SEQ ID NO: 42206 - DNA, 15 bp, Homo sapiens
ctttctttcattaag

SEQ ID NO: 42207 - DNA, 15 bp, Homo sapiens
tttctttcattaaga

SEQ ID NO: 42208 - DNA, 15 bp, Homo sapiens
ttctttcattaagaa

SEQ ID NO: 42209 - DNA, 15 bp, Homo sapiens
tctttcattaagaaa

SEQ ID NO: 42210 - DNA, 15 bp, Homo sapiens
ctttcattaagaaat

SEQ ID NO: 42211 - DNA, 15 bp, Homo sapiens
tttcattaagaaatc

SEQ ID NO: 42212 - DNA, 15 bp, Homo sapiens
ttcattaagaaatca

SEQ ID NO: 42213 - DNA, 15 bp, Homo sapiens
tcattaagaaatcat

SEQ ID NO: 42214 - DNA, 15 bp, Homo sapiens
cattaagaaatcata

SEQ ID NO: 42215 - DNA, 15 bp, Homo sapiens
attaagaaatcataa

SEQ ID NO: 42216 - DNA, 15 bp, Homo sapiens
ttaagaaatcataat

SEQ ID NO: 42217 - DNA, 15 bp, Homo sapiens
taagaaatcataatg

SEQ ID NO: 42218 - DNA, 15 bp, Homo sapiens
aagaaatcataatgt

SEQ ID NO: 42219 - DNA, 15 bp, Homo sapiens
agaaatcataatgta

SEQ ID NO: 42220 - DNA, 15 bp, Homo sapiens
gaaatcataatgtag

SEQ ID NO: 42221 - DNA, 15 bp, Homo sapiens
aaatcataatgtagt

SEQ ID NO: 42222 - DNA, 15 bp, Homo sapiens
aatcataatgtagtt

SEQ ID NO: 42223 - DNA, 15 bp, Homo sapiens
atcataatgtagttt

SEQ ID NO: 42224 - DNA, 15 bp, Homo sapiens
tcataatgtagtttt

SEQ ID NO: 42225 - DNA, 15 bp, Homo sapiens
cataatgtagttttt

SEQ ID NO: 42226 - DNA, 15 bp, Homo sapiens
ataatgtagtttttg

SEQ ID NO: 42227 - DNA, 15 bp, Homo sapiens
taatgtagtttttgg

SEQ ID NO: 42228 - DNA, 15 bp, Homo sapiens
aatgtagtttttggc

SEQ ID NO: 42229 - DNA, 15 bp, Homo sapiens
atgtagtttttggct

SEQ ID NO: 42230 - DNA, 15 bp, Homo sapiens
tgtagtttttggcta

SEQ ID NO: 42231 - DNA, 15 bp, Homo sapiens
gtagtttttggctaa

SEQ ID NO: 42232 - DNA, 15 bp, Homo sapiens
tagtttttggctaac

SEQ ID NO: 42233 - DNA, 15 bp, Homo sapiens
agtttttggctaact

SEQ ID NO: 42234 - DNA, 15 bp, Homo sapiens
gtttttggctaactt

SEQ ID NO: 42235 - DNA, 15 bp, Homo sapiens
tttttggctaacttg

SEQ ID NO: 42236 - DNA, 15 bp, Homo sapiens
ttttggctaacttgt

SEQ ID NO: 42237 - DNA, 15 bp, Homo sapiens
tttggctaacttgtg

SEQ ID NO: 42238 - DNA, 15 bp, Homo sapiens
ttggctaacttgtgg

SEQ ID NO: 42239 - DNA, 15 bp, Homo sapiens
tggctaacttgtgga

SEQ ID NO: 42240 - DNA, 15 bp, Homo sapiens
ggctaacttgtggaa

SEQ ID NO: 42241 - DNA, 15 bp, Homo sapiens
gctaacttgtggaac

SEQ ID NO: 42242 - DNA, 15 bp, Homo sapiens
ctaacttgtggaacc

SEQ ID NO: 42243 - DNA, 15 bp, Homo sapiens
taacttgtggaacca

SEQ ID NO: 42244 - DNA, 15 bp, Homo sapiens
aacttgtggaaccaa

SEQ ID NO: 42245 - DNA, 15 bp, Homo sapiens
acttgtggaaccaat

SEQ ID NO: 42246 - DNA, 15 bp, Homo sapiens
cttgtggaaccaatt

SEQ ID NO: 42247 - DNA, 15 bp, Homo sapiens
ttgtggaaccaattt

SEQ ID NO: 42248 - DNA, 15 bp, Homo sapiens
tgtggaaccaatttt

SEQ ID NO: 42249 - DNA, 15 bp, Homo sapiens
gtggaaccaattttt

SEQ ID NO: 42250 - DNA, 15 bp, Homo sapiens
tggaaccaatttttt

SEQ ID NO: 42251 - DNA, 15 bp, Homo sapiens
ggaaccaattttttt

SEQ ID NO: 42252 - DNA, 15 bp, Homo sapiens
gaaccaatttttttg

SEQ ID NO: 42253 - DNA, 15 bp, Homo sapiens
aaccaatttttttgg

SEQ ID NO: 42254 - DNA, 15 bp, Homo sapiens
accaatttttttggt

SEQ ID NO: 42255 - DNA, 15 bp, Homo sapiens
ccaatttttttggtc

SEQ ID NO: 42256 - DNA, 15 bp, Homo sapiens
caatttttttggtca

SEQ ID NO: 42257 - DNA, 15 bp, Homo sapiens
aatttttttggtcaa

SEQ ID NO: 42258 - DNA, 15 bp, Homo sapiens
atttttttggtcaaa

SEQ ID NO: 42259 - DNA, 15 bp, Homo sapiens
tttttttggtcaaat

SEQ ID NO: 42260 - DNA, 15 bp, Homo sapiens
ttttttggtcaaata

SEQ ID NO: 42261 - DNA, 15 bp, Homo sapiens
tttttggtcaaatat

SEQ ID NO: 42262 - DNA, 15 bp, Homo sapiens
ttttggtcaaatatt

SEQ ID NO: 42263 - DNA, 15 bp, Homo sapiens
tttggtcaaatattg

SEQ ID NO: 42264 - DNA, 15 bp, Homo sapiens
ttggtcaaatattga

SEQ ID NO: 42265 - DNA, 15 bp, Homo sapiens
tggtcaaatattgag

SEQ ID NO: 42266 - DNA, 15 bp, Homo sapiens
ggtcaaatattgaga

SEQ ID NO: 42267 - DNA, 15 bp, Homo sapiens
gtcaaatattgagag

SEQ ID NO: 42268 - DNA, 15 bp, Homo sapiens
tcaaatattgagagt

SEQ ID NO: 42269 - DNA, 15 bp, Homo sapiens
caaatattgagagtg

SEQ ID NO: 42270 - DNA, 15 bp, Homo sapiens
aaatattgagagtga

SEQ ID NO: 42271 - DNA, 15 bp, Homo sapiens
aatattgagagtgaa

SEQ ID NO: 42272 - DNA, 15 bp, Homo sapiens
atattgagagtgaag

SEQ ID NO: 42273 - DNA, 15 bp, Homo sapiens
tattgagagtgaagt

SEQ ID NO: 42274 - DNA, 15 bp, Homo sapiens
attgagagtgaagtt

SEQ ID NO: 42275 - DNA, 15 bp, Homo sapiens
ttgagagtgaagttt

SEQ ID NO: 42276 - DNA, 15 bp, Homo sapiens
tgagagtgaagtttg

SEQ ID NO: 42277 - DNA, 15 bp, Homo sapiens
gagagtgaagtttgc

SEQ ID NO: 42278 - DNA, 15 bp, Homo sapiens
agagtgaagtttgct

SEQ ID NO: 42279 - DNA, 15 bp, Homo sapiens
gagtgaagtttgcta

SEQ ID NO: 42280 - DNA, 15 bp, Homo sapiens
agtgaagtttgctac

SEQ ID NO: 42281 - DNA, 15 bp, Homo sapiens
gtgaagtttgctacc

SEQ ID NO: 42282 - DNA, 15 bp, Homo sapiens
tgaagtttgctacct

SEQ ID NO: 42283 - DNA, 15 bp, Homo sapiens
gaagtttgctacctg

SEQ ID NO: 42284 - DNA, 15 bp, Homo sapiens
aagtttgctacctgt

SEQ ID NO: 42285 - DNA, 15 bp, Homo sapiens
agtttgctacctgta

SEQ ID NO: 42286 - DNA, 15 bp, Homo sapiens
gtttgctacctgtaa

SEQ ID NO: 42287 - DNA, 15 bp, Homo sapiens
tttgctacctgtaac

SEQ ID NO: 42288 - DNA, 15 bp, Homo sapiens
ttgctacctgtaact

SEQ ID NO: 42289 - DNA, 15 bp, Homo sapiens
tgctacctgtaactt

SEQ ID NO: 42290 - DNA, 15 bp, Homo sapiens
gctacctgtaactta

SEQ ID NO: 42291 - DNA, 15 bp, Homo sapiens
ctacctgtaacttaa

SEQ ID NO: 42292 - DNA, 15 bp, Homo sapiens
tacctgtaacttaaa

SEQ ID NO: 42293 - DNA, 15 bp, Homo sapiens
acctgtaacttaaag

SEQ ID NO: 42294 - DNA, 15 bp, Homo sapiens
cctgtaacttaaagt

SEQ ID NO: 42295 - DNA, 15 bp, Homo sapiens
ctgtaacttaaagta

SEQ ID NO: 42296 - DNA, 15 bp, Homo sapiens
tgtaacttaaagtaa

SEQ ID NO: 42297 - DNA, 15 bp, Homo sapiens
gtaacttaaagtaac

SEQ ID NO: 42298 - DNA, 15 bp, Homo sapiens
taacttaaagtaaca

SEQ ID NO: 42299 - DNA, 15 bp, Homo sapiens
aacttaaagtaacat

SEQ ID NO: 42300 - DNA, 15 bp, Homo sapiens
acttaaagtaacatt

SEQ ID NO: 42301 - DNA, 15 bp, Homo sapiens
cttaaagtaacattt

SEQ ID NO: 42302 - DNA, 15 bp, Homo sapiens
ttaaagtaacattta

SEQ ID NO: 42303 - DNA, 15 bp, Homo sapiens
taaagtaacatttag

SEQ ID NO: 42304 - DNA, 15 bp, Homo sapiens
aaagtaacatttaga

SEQ ID NO: 42305 - DNA, 15 bp, Homo sapiens
aagtaacatttagag

SEQ ID NO: 42306 - DNA, 15 bp, Homo sapiens
agtaacatttagaga

SEQ ID NO: 42307 - DNA, 15 bp, Homo sapiens
gtaacatttagagac

SEQ ID NO: 42308 - DNA, 15 bp, Homo sapiens
taacatttagagaca

SEQ ID NO: 42309 - DNA, 15 bp, Homo sapiens
aacatttagagacat

SEQ ID NO: 42310 - DNA, 15 bp, Homo sapiens
acatttagagacata

SEQ ID NO: 42311 - DNA, 15 bp, Homo sapiens
catttagagacatat

SEQ ID NO: 42312 - DNA, 15 bp, Homo sapiens
atttagagacatatt

SEQ ID NO: 42313 - DNA, 15 bp, Homo sapiens
tttagagacatattt

SEQ ID NO: 42314 - DNA, 15 bp, Homo sapiens
ttagagacatatttt

SEQ ID NO: 42315 - DNA, 15 bp, Homo sapiens
tagagacatatttta

SEQ ID NO: 42316 - DNA, 15 bp, Homo sapiens
agagacatattttac

SEQ ID NO: 42317 - DNA, 15 bp, Homo sapiens
gagacatattttact

SEQ ID NO: 42318 - DNA, 15 bp, Homo sapiens
agacatattttactc

SEQ ID NO: 42319 - DNA, 15 bp, Homo sapiens
gacatattttactca

SEQ ID NO: 42320 - DNA, 15 bp, Homo sapiens
acatattttactcag

SEQ ID NO: 42321 - DNA, 15 bp, Homo sapiens
catattttactcaga

SEQ ID NO: 42322 - DNA, 15 bp, Homo sapiens
atattttactcagat

SEQ ID NO: 42323 - DNA, 15 bp, Homo sapiens
tattttactcagatt

SEQ ID NO: 42324 - DNA, 15 bp, Homo sapiens
attttactcagattg

SEQ ID NO: 42325 - DNA, 15 bp, Homo sapiens
ttttactcagattga

SEQ ID NO: 42326 - DNA, 15 bp, Homo sapiens
tttactcagattgac

SEQ ID NO: 42327 - DNA, 15 bp, Homo sapiens
ttactcagattgacc

SEQ ID NO: 42328 - DNA, 15 bp, Homo sapiens
tactcagattgaccc

SEQ ID NO: 42329 - DNA, 15 bp, Homo sapiens
actcagattgaccct

SEQ ID NO: 42330 - DNA, 15 bp, Homo sapiens
ctcagattgacccta

SEQ ID NO: 42331 - DNA, 15 bp, Homo sapiens
tcagattgaccctaa

SEQ ID NO: 42332 - DNA, 15 bp, Homo sapiens
cagattgaccctaat

SEQ ID NO: 42333 - DNA, 15 bp, Homo sapiens
agattgaccctaatt

SEQ ID NO: 42334 - DNA, 15 bp, Homo sapiens
gattgaccctaatta

SEQ ID NO: 42335 - DNA, 15 bp, Homo sapiens
attgaccctaattat

SEQ ID NO: 42336 - DNA, 15 bp, Homo sapiens
ttgaccctaattata

SEQ ID NO: 42337 - DNA, 15 bp, Homo sapiens
tgaccctaattatat

SEQ ID NO: 42338 - DNA, 15 bp, Homo sapiens
gaccctaattatata

SEQ ID NO: 42339 - DNA, 15 bp, Homo sapiens
accctaattatatat

SEQ ID NO: 42340 - DNA, 15 bp, Homo sapiens
ccctaattatatatc

SEQ ID NO: 42341 - DNA, 15 bp, Homo sapiens
cctaattatatatct

SEQ ID NO: 42342 - DNA, 15 bp, Homo sapiens
ctaattatatatcta

SEQ ID NO: 42343 - DNA, 15 bp, Homo sapiens
taattatatatctat

SEQ ID NO: 42344 - DNA, 15 bp, Homo sapiens
aattatatatctatg

SEQ ID NO: 42345 - DNA, 15 bp, Homo sapiens
attatatatctatga

SEQ ID NO: 42346 - DNA, 15 bp, Homo sapiens
ttatatatctatgac

SEQ ID NO: 42347 - DNA, 15 bp, Homo sapiens
tatatatctatgaca

SEQ ID NO: 42348 - DNA, 15 bp, Homo sapiens
atatatctatgacat

SEQ ID NO: 42349 - DNA, 15 bp, Homo sapiens
tatatctatgacatg

SEQ ID NO: 42350 - DNA, 15 bp, Homo sapiens
atatctatgacatga

SEQ ID NO: 42351 - DNA, 15 bp, Homo sapiens
tatctatgacatgat

SEQ ID NO: 42352 - DNA, 15 bp, Homo sapiens
atctatgacatgatt

SEQ ID NO: 42353 - DNA, 15 bp, Homo sapiens
tctatgacatgattt

SEQ ID NO: 42354 - DNA, 15 bp, Homo sapiens
ctatgacatgatttt

SEQ ID NO: 42355 - DNA, 15 bp, Homo sapiens
tatgacatgattttt

SEQ ID NO: 42356 - DNA, 15 bp, Homo sapiens
atgacatgattttta

SEQ ID NO: 42357 - DNA, 15 bp, Homo sapiens
tgacatgatttttaa

SEQ ID NO: 42358 - DNA, 15 bp, Homo sapiens
gacatgatttttaaa

SEQ ID NO: 42359 - DNA, 15 bp, Homo sapiens
acatgatttttaaat

SEQ ID NO: 42360 - DNA, 15 bp, Homo sapiens
catgatttttaaatt

SEQ ID NO: 42361 - DNA, 15 bp, Homo sapiens
atgatttttaaattg

SEQ ID NO: 42362 - DNA, 15 bp, Homo sapiens
tgatttttaaattga

SEQ ID NO: 42363 - DNA, 15 bp, Homo sapiens
gatttttaaattgaa

SEQ ID NO: 42364 - DNA, 15 bp, Homo sapiens
atttttaaattgaaa

SEQ ID NO: 42365 - DNA, 15 bp, Homo sapiens
tttttaaattgaaat

SEQ ID NO: 42366 - DNA, 15 bp, Homo sapiens
ttttaaattgaaatc

SEQ ID NO: 42367 - DNA, 15 bp, Homo sapiens
tttaaattgaaatca

SEQ ID NO: 42368 - DNA, 15 bp, Homo sapiens
ttaaattgaaatcag

SEQ ID NO: 42369 - DNA, 15 bp, Homo sapiens
taaattgaaatcagc

SEQ ID NO: 42370 - DNA, 15 bp, Homo sapiens
aaattgaaatcagct

SEQ ID NO: 42371 - DNA, 15 bp, Homo sapiens
aattgaaatcagctg

SEQ ID NO: 42372 - DNA, 15 bp, Homo sapiens
attgaaatcagctgg

SEQ ID NO: 42373 - DNA, 15 bp, Homo sapiens
ttgaaatcagctggg

SEQ ID NO: 42374 - DNA, 15 bp, Homo sapiens
tgaaatcagctgggc

SEQ ID NO: 42375 - DNA, 15 bp, Homo sapiens
agctgggcatggtgt

SEQ ID NO: 42376 - DNA, 15 bp, Homo sapiens
gctgggcatggtgtc

SEQ ID NO: 42377 - DNA, 15 bp, Homo sapiens
ctgggcatggtgtct

SEQ ID NO: 42378 - DNA, 15 bp, Homo sapiens
tgggcatggtgtctc

SEQ ID NO: 42379 - DNA, 15 bp, Homo sapiens
gggcatggtgtctca

SEQ ID NO: 42380 - DNA, 15 bp, Homo sapiens
ggcatggtgtctcat

SEQ ID NO: 42381 - DNA, 15 bp, Homo sapiens
gcatggtgtctcatg

SEQ ID NO: 42382 - DNA, 15 bp, Homo sapiens
catggtgtctcatgc

SEQ ID NO: 42383 - DNA, 15 bp, Homo sapiens
atggtgtctcatgcc

SEQ ID NO: 42384 - DNA, 15 bp, Homo sapiens
tggtgtctcatgcct

SEQ ID NO: 42385 - DNA, 15 bp, Homo sapiens
ggtgtctcatgcctg

SEQ ID NO: 42386 - DNA, 15 bp, Homo sapiens
gtgtctcatgcctgt

SEQ ID NO: 42387 - DNA, 15 bp, Homo sapiens
tgtctcatgcctgta

SEQ ID NO: 42388 - DNA, 15 bp, Homo sapiens
gtctcatgcctgtaa

SEQ ID NO: 42389 - DNA, 15 bp, Homo sapiens
tctcatgcctgtaat

SEQ ID NO: 42390 - DNA, 15 bp, Homo sapiens
gaggccgaggtgggg

SEQ ID NO: 42391 - DNA, 15 bp, Homo sapiens
aggccgaggtggggg

SEQ ID NO: 42392 - DNA, 15 bp, Homo sapiens
ggccgaggtgggggg

SEQ ID NO: 42393 - DNA, 15 bp, Homo sapiens
gccgaggtgggggga

SEQ ID NO: 42394 - DNA, 15 bp, Homo sapiens
ccgaggtggggggat

SEQ ID NO: 42395 - DNA, 15 bp, Homo sapiens
cgaggtggggggatc

SEQ ID NO: 42396 - DNA, 15 bp, Homo sapiens
gaggtggggggatca

SEQ ID NO: 42397 - DNA, 15 bp, Homo sapiens
aggtggggggatcac

SEQ ID NO: 42398 - DNA, 15 bp, Homo sapiens
ggtggggggatcacc

SEQ ID NO: 42399 - DNA, 15 bp, Homo sapiens
gtggggggatcacct

SEQ ID NO: 42400 - DNA, 15 bp, Homo sapiens
tggggggatcacctc

SEQ ID NO: 42401 - DNA, 15 bp, Homo sapiens
ggggggatcacctca

SEQ ID NO: 42402 - DNA, 15 bp, Homo sapiens
gggggatcacctcag

SEQ ID NO: 42403 - DNA, 15 bp, Homo sapiens
ggggatcacctcagg

SEQ ID NO: 42404 - DNA, 15 bp, Homo sapiens
gggatcacctcaggt

SEQ ID NO: 42405 - DNA, 15 bp, Homo sapiens
ggatcacctcaggtc

SEQ ID NO: 42406 - DNA, 15 bp, Homo sapiens
gatcacctcaggtca

SEQ ID NO: 42407 - DNA, 15 bp, Homo sapiens
atcacctcaggtcag

SEQ ID NO: 42408 - DNA, 15 bp, Homo sapiens
tcacctcaggtcagg

SEQ ID NO: 42409 - DNA, 15 bp, Homo sapiens
cacctcaggtcagga

SEQ ID NO: 42410 - DNA, 15 bp, Homo sapiens
acctcaggtcaggag

SEQ ID NO: 42411 - DNA, 15 bp, Homo sapiens
cctcaggtcaggagt

SEQ ID NO: 42412 - DNA, 15 bp, Homo sapiens
ctcaggtcaggagtt

SEQ ID NO: 42413 - DNA, 15 bp, Homo sapiens
tcaggtcaggagttt

SEQ ID NO: 42414 - DNA, 15 bp, Homo sapiens
caggtcaggagtttg

SEQ ID NO: 42415 - DNA, 15 bp, Homo sapiens
tttgagaccagcctt

SEQ ID NO: 42416 - DNA, 15 bp, Homo sapiens
ttgagaccagccttg

SEQ ID NO: 42417 - DNA, 15 bp, Homo sapiens
tgagaccagccttgg

SEQ ID NO: 42418 - DNA, 15 bp, Homo sapiens
gagaccagccttggc

SEQ ID NO: 42419 - DNA, 15 bp, Homo sapiens
agaccagccttggcc

SEQ ID NO: 42420 - DNA, 15 bp, Homo sapiens
gaccagccttggcca

SEQ ID NO: 42421 - DNA, 15 bp, Homo sapiens
accagccttggccaa

SEQ ID NO: 42422 - DNA, 15 bp, Homo sapiens
ccagccttggccaac

SEQ ID NO: 42423 - DNA, 15 bp, Homo sapiens
cagccttggccaaca

SEQ ID NO: 42424 - DNA, 15 bp, Homo sapiens
agccttggccaacat

SEQ ID NO: 42425 - DNA, 15 bp, Homo sapiens
gccttggccaacata

SEQ ID NO: 42426 - DNA, 15 bp, Homo sapiens
ccttggccaacatag

SEQ ID NO: 42427 - DNA, 15 bp, Homo sapiens
cttggccaacatagc

SEQ ID NO: 42428 - DNA, 15 bp, Homo sapiens
ttggccaacatagca

SEQ ID NO: 42429 - DNA, 15 bp, Homo sapiens
tggccaacatagcaa

SEQ ID NO: 42430 - DNA, 15 bp, Homo sapiens
ggccaacatagcaaa

SEQ ID NO: 42431 - DNA, 15 bp, Homo sapiens
gccaacatagcaaaa

SEQ ID NO: 42432 - DNA, 15 bp, Homo sapiens
ccaacatagcaaaac

SEQ ID NO: 42433 - DNA, 15 bp, Homo sapiens
caacatagcaaaacc

SEQ ID NO: 42434 - DNA, 15 bp, Homo sapiens
aacatagcaaaacct

SEQ ID NO: 42435 - DNA, 15 bp, Homo sapiens
acatagcaaaacctg

SEQ ID NO: 42436 - DNA, 15 bp, Homo sapiens
catagcaaaacctgt

SEQ ID NO: 42437 - DNA, 15 bp, Homo sapiens
atagcaaaacctgtc

SEQ ID NO: 42438 - DNA, 15 bp, Homo sapiens
tagcaaaacctgtct

SEQ ID NO: 42439 - DNA, 15 bp, Homo sapiens
agcaaaacctgtctc

SEQ ID NO: 42440 - DNA, 15 bp, Homo sapiens
gcaaaacctgtctct

SEQ ID NO: 42441 - DNA, 15 bp, Homo sapiens
caaaacctgtctcta

SEQ ID NO: 42442 - DNA, 15 bp, Homo sapiens
aaaacctgtctctac

SEQ ID NO: 42443 - DNA, 15 bp, Homo sapiens
aaacctgtctctact

SEQ ID NO: 42444 - DNA, 15 bp, Homo sapiens
aacctgtctctacta

SEQ ID NO: 42445 - DNA, 15 bp, Homo sapiens
acctgtctctactaa

SEQ ID NO: 42446 - DNA, 15 bp, Homo sapiens
cctgtctctactaaa

SEQ ID NO: 42447 - DNA, 15 bp, Homo sapiens
gggcatggtggcaca

SEQ ID NO: 42448 - DNA, 15 bp, Homo sapiens
ggcatggtggcacat

SEQ ID NO: 42449 - DNA, 15 bp, Homo sapiens
gcatggtggcacatg

SEQ ID NO: 42450 - DNA, 15 bp, Homo sapiens
catggtggcacatgc

SEQ ID NO: 42451 - DNA, 15 bp, Homo sapiens
ggcacatgcctgtaa

SEQ ID NO: 42452 - DNA, 15 bp, Homo sapiens
gcacatgcctgtaat

SEQ ID NO: 42453 - DNA, 15 bp, Homo sapiens
cacatgcctgtaatc

SEQ ID NO: 42454 - DNA, 15 bp, Homo sapiens
acatgcctgtaatcc

SEQ ID NO: 42455 - DNA, 15 bp, Homo sapiens
tgggaggctgaggct

SEQ ID NO: 42456 - DNA, 15 bp, Homo sapiens
gggaggctgaggctg

SEQ ID NO: 42457 - DNA, 15 bp, Homo sapiens
ggaggctgaggctgg

SEQ ID NO: 42458 - DNA, 15 bp, Homo sapiens
gaggctgaggctgga

SEQ ID NO: 42459 - DNA, 15 bp, Homo sapiens
aggctgaggctggaa

SEQ ID NO: 42460 - DNA, 15 bp, Homo sapiens
ggctgaggctggaaa

SEQ ID NO: 42461 - DNA, 15 bp, Homo sapiens
gctgaggctggaaaa

SEQ ID NO: 42462 - DNA, 15 bp, Homo sapiens
ctgaggctggaaaat

SEQ ID NO: 42463 - DNA, 15 bp, Homo sapiens
tgaggctggaaaatt

SEQ ID NO: 42464 - DNA, 15 bp, Homo sapiens
gaggctggaaaattg

SEQ ID NO: 42465 - DNA, 15 bp, Homo sapiens
aggctggaaaattgc

SEQ ID NO: 42466 - DNA, 15 bp, Homo sapiens
ggctggaaaattgcc

SEQ ID NO: 42467 - DNA, 15 bp, Homo sapiens
gctggaaaattgccc

SEQ ID NO: 42468 - DNA, 15 bp, Homo sapiens
ctggaaaattgcccg

SEQ ID NO: 42469 - DNA, 15 bp, Homo sapiens
tggaaaattgcccgg

SEQ ID NO: 42470 - DNA, 15 bp, Homo sapiens
ggaaaattgcccggg

SEQ ID NO: 42471 - DNA, 15 bp, Homo sapiens
gaaaattgcccggga

SEQ ID NO: 42472 - DNA, 15 bp, Homo sapiens
aaaattgcccgggag

SEQ ID NO: 42473 - DNA, 15 bp, Homo sapiens
aaattgcccgggagg

SEQ ID NO: 42474 - DNA, 15 bp, Homo sapiens
aattgcccgggaggc

SEQ ID NO: 42475 - DNA, 15 bp, Homo sapiens
attgcccgggaggca

SEQ ID NO: 42476 - DNA, 15 bp, Homo sapiens
ttgcccgggaggcag

SEQ ID NO: 42477 - DNA, 15 bp, Homo sapiens
tgcccgggaggcaga

SEQ ID NO: 42478 - DNA, 15 bp, Homo sapiens
gcccgggaggcagag

SEQ ID NO: 42479 - DNA, 15 bp, Homo sapiens
cccgggaggcagagg

SEQ ID NO: 42480 - DNA, 15 bp, Homo sapiens
ccgggaggcagaggt

SEQ ID NO: 42481 - DNA, 15 bp, Homo sapiens
cgggaggcagaggtt

SEQ ID NO: 42482 - DNA, 15 bp, Homo sapiens
gggaggcagaggttt

SEQ ID NO: 42483 - DNA, 15 bp, Homo sapiens
ggaggcagaggtttc

SEQ ID NO: 42484 - DNA, 15 bp, Homo sapiens
gaggcagaggtttca

SEQ ID NO: 42485 - DNA, 15 bp, Homo sapiens
aggcagaggtttcag

SEQ ID NO: 42486 - DNA, 15 bp, Homo sapiens
ggcagaggtttcagt

SEQ ID NO: 42487 - DNA, 15 bp, Homo sapiens
gcagaggtttcagta

SEQ ID NO: 42488 - DNA, 15 bp, Homo sapiens
cagaggtttcagtaa

SEQ ID NO: 42489 - DNA, 15 bp, Homo sapiens
agaggtttcagtaag

SEQ ID NO: 42490 - DNA, 15 bp, Homo sapiens
gaggtttcagtaagc

SEQ ID NO: 42491 - DNA, 15 bp, Homo sapiens
aggtttcagtaagcc

SEQ ID NO: 42492 - DNA, 15 bp, Homo sapiens
ggtttcagtaagcca

SEQ ID NO: 42493 - DNA, 15 bp, Homo sapiens
gtttcagtaagccaa

SEQ ID NO: 42494 - DNA, 15 bp, Homo sapiens
tttcagtaagccaag

SEQ ID NO: 42495 - DNA, 15 bp, Homo sapiens
ttcagtaagccaaga

SEQ ID NO: 42496 - DNA, 15 bp, Homo sapiens
tcagtaagccaagat

SEQ ID NO: 42497 - DNA, 15 bp, Homo sapiens
cagtaagccaagatt

SEQ ID NO: 42498 - DNA, 15 bp, Homo sapiens
agtaagccaagattg

SEQ ID NO: 42499 - DNA, 15 bp, Homo sapiens
gtaagccaagattgt

SEQ ID NO: 42500 - DNA, 15 bp, Homo sapiens
taagccaagattgtg

SEQ ID NO: 42501 - DNA, 15 bp, Homo sapiens
aagccaagattgtgc

SEQ ID NO: 42502 - DNA, 15 bp, Homo sapiens
agccaagattgtgcc

SEQ ID NO: 42503 - DNA, 15 bp, Homo sapiens
gccaagattgtgcca

SEQ ID NO: 42504 - DNA, 15 bp, Homo sapiens
ccaagattgtgccac

SEQ ID NO: 42505 - DNA, 15 bp, Homo sapiens
caagattgtgccact

SEQ ID NO: 42506 - DNA, 15 bp, Homo sapiens
aagattgtgccactg

SEQ ID NO: 42507 - DNA, 15 bp, Homo sapiens
agattgtgccactgg

SEQ ID NO: 42508 - DNA, 15 bp, Homo sapiens
gattgtgccactgga

SEQ ID NO: 42509 - DNA, 15 bp, Homo sapiens
attgtgccactggac

SEQ ID NO: 42510 - DNA, 15 bp, Homo sapiens
ttgtgccactggact

SEQ ID NO: 42511 - DNA, 15 bp, Homo sapiens
tgtgccactggactc

SEQ ID NO: 42512 - DNA, 15 bp, Homo sapiens
gtgccactggactcc

SEQ ID NO: 42513 - DNA, 15 bp, Homo sapiens
tgccactggactcca

SEQ ID NO: 42514 - DNA, 15 bp, Homo sapiens
gccactggactccag

SEQ ID NO: 42515 - DNA, 15 bp, Homo sapiens
ccactggactccagc

SEQ ID NO: 42516 - DNA, 15 bp, Homo sapiens
cactggactccagcc

SEQ ID NO: 42517 - DNA, 15 bp, Homo sapiens
actggactccagcct

SEQ ID NO: 42518 - DNA, 15 bp, Homo sapiens
ctggactccagcctg

SEQ ID NO: 42519 - DNA, 15 bp, Homo sapiens
tggactccagcctgg

SEQ ID NO: 42520 - DNA, 15 bp, Homo sapiens
ggactccagcctggg

SEQ ID NO: 42521 - DNA, 15 bp, Homo sapiens
gactccagcctgggc

SEQ ID NO: 42522 - DNA, 15 bp, Homo sapiens
ctgggcaacaaagca

SEQ ID NO: 42523 - DNA, 15 bp, Homo sapiens
tgggcaacaaagcaa

SEQ ID NO: 42524 - DNA, 15 bp, Homo sapiens
gggcaacaaagcaag

SEQ ID NO: 42525 - DNA, 15 bp, Homo sapiens
caacaaagcaagact

SEQ ID NO: 42526 - DNA, 15 bp, Homo sapiens
aacaaagcaagactc

SEQ ID NO: 42527 - DNA, 15 bp, Homo sapiens
acaaagcaagactcc

SEQ ID NO: 42528 - DNA, 15 bp, Homo sapiens
caaagcaagactccg

SEQ ID NO: 42529 - DNA, 15 bp, Homo sapiens
aaagcaagactccgt

SEQ ID NO: 42530 - DNA, 15 bp, Homo sapiens
aagcaagactccgtc

SEQ ID NO: 42531 - DNA, 15 bp, Homo sapiens
agcaagactccgtct

SEQ ID NO: 42532 - DNA, 15 bp, Homo sapiens
gcaagactccgtctc

SEQ ID NO: 42533 - DNA, 15 bp, Homo sapiens
caagactccgtctca

SEQ ID NO: 42534 - DNA, 15 bp, Homo sapiens
aagactccgtctcaa

SEQ ID NO: 42535 - DNA, 15 bp, Homo sapiens
aaaaaaaaaaagtag

SEQ ID NO: 42536 - DNA, 15 bp, Homo sapiens
aaaaaaaaaagtagt

SEQ ID NO: 42537 - DNA, 15 bp, Homo sapiens
aaaaaaaaagtagtt

SEQ ID NO: 42538 - DNA, 15 bp, Homo sapiens
aaaaaaaagtagttc

SEQ ID NO: 42539 - DNA, 15 bp, Homo sapiens
aaaaaaagtagttct

SEQ ID NO: 42540 - DNA, 15 bp, Homo sapiens
aaaaaagtagttctt

SEQ ID NO: 42541 - DNA, 15 bp, Homo sapiens
aaaaagtagttcttt

SEQ ID NO: 42542 - DNA, 15 bp, Homo sapiens
aaaagtagttcttta

SEQ ID NO: 42543 - DNA, 15 bp, Homo sapiens
aaagtagttctttat

SEQ ID NO: 42544 - DNA, 15 bp, Homo sapiens
aagtagttctttatt

SEQ ID NO: 42545 - DNA, 15 bp, Homo sapiens
agtagttctttattt

SEQ ID NO: 42546 - DNA, 15 bp, Homo sapiens
gtagttctttattta

SEQ ID NO: 42547 - DNA, 15 bp, Homo sapiens
tagttctttatttac

SEQ ID NO: 42548 - DNA, 15 bp, Homo sapiens
agttctttatttacc

SEQ ID NO: 42549 - DNA, 15 bp, Homo sapiens
gttctttatttacca

SEQ ID NO: 42550 - DNA, 15 bp, Homo sapiens
ttctttatttaccat

SEQ ID NO: 42551 - DNA, 15 bp, Homo sapiens
tctttatttaccatg

SEQ ID NO: 42552 - DNA, 15 bp, Homo sapiens
ctttatttaccatgc

SEQ ID NO: 42553 - DNA, 15 bp, Homo sapiens
tttatttaccatgcg

SEQ ID NO: 42554 - DNA, 15 bp, Homo sapiens
ttatttaccatgcga

SEQ ID NO: 42555 - DNA, 15 bp, Homo sapiens
tatttaccatgcgat

SEQ ID NO: 42556 - DNA, 15 bp, Homo sapiens
atttaccatgcgatc

SEQ ID NO: 42557 - DNA, 15 bp, Homo sapiens
tttaccatgcgatct

SEQ ID NO: 42558 - DNA, 15 bp, Homo sapiens
ttaccatgcgatctt

SEQ ID NO: 42559 - DNA, 15 bp, Homo sapiens
taccatgcgatcttt

SEQ ID NO: 42560 - DNA, 15 bp, Homo sapiens
accatgcgatctttc

SEQ ID NO: 42561 - DNA, 15 bp, Homo sapiens
ccatgcgatctttcc

SEQ ID NO: 42562 - DNA, 15 bp, Homo sapiens
catgcgatctttcca

SEQ ID NO: 42563 - DNA, 15 bp, Homo sapiens
atgcgatctttccag

SEQ ID NO: 42564 - DNA, 15 bp, Homo sapiens
tgcgatctttccagt

SEQ ID NO: 42565 - DNA, 15 bp, Homo sapiens
gcgatctttccagta

SEQ ID NO: 42566 - DNA, 15 bp, Homo sapiens
cgatctttccagtac

SEQ ID NO: 42567 - DNA, 15 bp, Homo sapiens
gatctttccagtaca

SEQ ID NO: 42568 - DNA, 15 bp, Homo sapiens
atctttccagtacac

SEQ ID NO: 42569 - DNA, 15 bp, Homo sapiens
tctttccagtacact

SEQ ID NO: 42570 - DNA, 15 bp, Homo sapiens
ctttccagtacactt

SEQ ID NO: 42571 - DNA, 15 bp, Homo sapiens
tttccagtacacttg

SEQ ID NO: 42572 - DNA, 15 bp, Homo sapiens
ttccagtacacttgc

SEQ ID NO: 42573 - DNA, 15 bp, Homo sapiens
tccagtacacttgct

SEQ ID NO: 42574 - DNA, 15 bp, Homo sapiens
ccagtacacttgcta

SEQ ID NO: 42575 - DNA, 15 bp, Homo sapiens
cagtacacttgctaa

SEQ ID NO: 42576 - DNA, 15 bp, Homo sapiens
agtacacttgctaat

SEQ ID NO: 42577 - DNA, 15 bp, Homo sapiens
gtacacttgctaatt

SEQ ID NO: 42578 - DNA, 15 bp, Homo sapiens
tacacttgctaattg

SEQ ID NO: 42579 - DNA, 15 bp, Homo sapiens
acacttgctaattgc

SEQ ID NO: 42580 - DNA, 15 bp, Homo sapiens
cacttgctaattgct

SEQ ID NO: 42581 - DNA, 15 bp, Homo sapiens
acttgctaattgcta

SEQ ID NO: 42582 - DNA, 15 bp, Homo sapiens
cttgctaattgctac

SEQ ID NO: 42583 - DNA, 15 bp, Homo sapiens
ttgctaattgctact

SEQ ID NO: 42584 - DNA, 15 bp, Homo sapiens
tgctaattgctactc

SEQ ID NO: 42585 - DNA, 15 bp, Homo sapiens
gctaattgctactcc

SEQ ID NO: 42586 - DNA, 15 bp, Homo sapiens
ctaattgctactcca

SEQ ID NO: 42587 - DNA, 15 bp, Homo sapiens
taattgctactccag

SEQ ID NO: 42588 - DNA, 15 bp, Homo sapiens
aattgctactccaga

SEQ ID NO: 42589 - DNA, 15 bp, Homo sapiens
attgctactccagag

SEQ ID NO: 42590 - DNA, 15 bp, Homo sapiens
ttgctactccagagc

SEQ ID NO: 42591 - DNA, 15 bp, Homo sapiens
tgctactccagagca

SEQ ID NO: 42592 - DNA, 15 bp, Homo sapiens
gctactccagagcat

SEQ ID NO: 42593 - DNA, 15 bp, Homo sapiens
ctactccagagcata

SEQ ID NO: 42594 - DNA, 15 bp, Homo sapiens
tactccagagcatag

SEQ ID NO: 42595 - DNA, 15 bp, Homo sapiens
actccagagcatagc

SEQ ID NO: 42596 - DNA, 15 bp, Homo sapiens
ctccagagcatagcc

SEQ ID NO: 42597 - DNA, 15 bp, Homo sapiens
tccagagcatagcca

SEQ ID NO: 42598 - DNA, 15 bp, Homo sapiens
ccagagcatagccag

SEQ ID NO: 42599 - DNA, 15 bp, Homo sapiens
cagagcatagccaga

SEQ ID NO: 42600 - DNA, 15 bp, Homo sapiens
agagcatagccagat

SEQ ID NO: 42601 - DNA, 15 bp, Homo sapiens
gagcatagccagatg

SEQ ID NO: 42602 - DNA, 15 bp, Homo sapiens
agcatagccagatgt

SEQ ID NO: 42603 - DNA, 15 bp, Homo sapiens
gcatagccagatgtg

SEQ ID NO: 42604 - DNA, 15 bp, Homo sapiens
catagccagatgtgg

SEQ ID NO: 42605 - DNA, 15 bp, Homo sapiens
atagccagatgtggc

SEQ ID NO: 42606 - DNA, 15 bp, Homo sapiens
tagccagatgtggcc

SEQ ID NO: 42607 - DNA, 15 bp, Homo sapiens
agccagatgtggccc

SEQ ID NO: 42608 - DNA, 15 bp, Homo sapiens
gccagatgtggccca

SEQ ID NO: 42609 - DNA, 15 bp, Homo sapiens
ccagatgtggcccac

SEQ ID NO: 42610 - DNA, 15 bp, Homo sapiens
cagatgtggcccaca

SEQ ID NO: 42611 - DNA, 15 bp, Homo sapiens
agatgtggcccacac

SEQ ID NO: 42612 - DNA, 15 bp, Homo sapiens
gatgtggcccacacc

SEQ ID NO: 42613 - DNA, 15 bp, Homo sapiens
atgtggcccacacct

SEQ ID NO: 42614 - DNA, 15 bp, Homo sapiens
tgtggcccacacctg

SEQ ID NO: 42615 - DNA, 15 bp, Homo sapiens
gtggcccacacctgt

SEQ ID NO: 42616 - DNA, 15 bp, Homo sapiens
tggcccacacctgta

SEQ ID NO: 42617 - DNA, 15 bp, Homo sapiens
ggcccacacctgtaa

SEQ ID NO: 42618 - DNA, 15 bp, Homo sapiens
gcccacacctgtaat

SEQ ID NO: 42619 - DNA, 15 bp, Homo sapiens
cccacacctgtaatt

SEQ ID NO: 42620 - DNA, 15 bp, Homo sapiens
ccacacctgtaattc

SEQ ID NO: 42621 - DNA, 15 bp, Homo sapiens
cacacctgtaattcc

SEQ ID NO: 42622 - DNA, 15 bp, Homo sapiens
acacctgtaattcca

SEQ ID NO: 42623 - DNA, 15 bp, Homo sapiens
cacctgtaattccag

SEQ ID NO: 42624 - DNA, 15 bp, Homo sapiens
acctgtaattccagc

SEQ ID NO: 42625 - DNA, 15 bp, Homo sapiens
attccagcactttga

SEQ ID NO: 42626 - DNA, 15 bp, Homo sapiens
ttccagcactttgag

SEQ ID NO: 42627 - DNA, 15 bp, Homo sapiens
tccagcactttgagg

SEQ ID NO: 42628 - DNA, 15 bp, Homo sapiens
ccagcactttgagga

SEQ ID NO: 42629 - DNA, 15 bp, Homo sapiens
cagcactttgaggag

SEQ ID NO: 42630 - DNA, 15 bp, Homo sapiens
agcactttgaggagg

SEQ ID NO: 42631 - DNA, 15 bp, Homo sapiens
gcactttgaggagga

SEQ ID NO: 42632 - DNA, 15 bp, Homo sapiens
cactttgaggaggac

SEQ ID NO: 42633 - DNA, 15 bp, Homo sapiens
actttgaggaggaca

SEQ ID NO: 42634 - DNA, 15 bp, Homo sapiens
ctttgaggaggacaa

SEQ ID NO: 42635 - DNA, 15 bp, Homo sapiens
tttgaggaggacaag

SEQ ID NO: 42636 - DNA, 15 bp, Homo sapiens
ttgaggaggacaaga

SEQ ID NO: 42637 - DNA, 15 bp, Homo sapiens
tgaggaggacaagat

SEQ ID NO: 42638 - DNA, 15 bp, Homo sapiens
gaggaggacaagatg

SEQ ID NO: 42639 - DNA, 15 bp, Homo sapiens
aggaggacaagatga

SEQ ID NO: 42640 - DNA, 15 bp, Homo sapiens
ggaggacaagatgag

SEQ ID NO: 42641 - DNA, 15 bp, Homo sapiens
gaggacaagatgagc

SEQ ID NO: 42642 - DNA, 15 bp, Homo sapiens
aggacaagatgagca

SEQ ID NO: 42643 - DNA, 15 bp, Homo sapiens
ggacaagatgagcaa

SEQ ID NO: 42644 - DNA, 15 bp, Homo sapiens
gacaagatgagcaaa

SEQ ID NO: 42645 - DNA, 15 bp, Homo sapiens
acaagatgagcaaat

SEQ ID NO: 42646 - DNA, 15 bp, Homo sapiens
caagatgagcaaatt

SEQ ID NO: 42647 - DNA, 15 bp, Homo sapiens
aagatgagcaaattg

SEQ ID NO: 42648 - DNA, 15 bp, Homo sapiens
agatgagcaaattgt

SEQ ID NO: 42649 - DNA, 15 bp, Homo sapiens
gatgagcaaattgtt

SEQ ID NO: 42650 - DNA, 15 bp, Homo sapiens
atgagcaaattgttt

SEQ ID NO: 42651 - DNA, 15 bp, Homo sapiens
tgagcaaattgtttg

SEQ ID NO: 42652 - DNA, 15 bp, Homo sapiens
gagcaaattgtttga

SEQ ID NO: 42653 - DNA, 15 bp, Homo sapiens
agcaaattgtttgag

SEQ ID NO: 42654 - DNA, 15 bp, Homo sapiens
gcaaattgtttgagt

SEQ ID NO: 42655 - DNA, 15 bp, Homo sapiens
caaattgtttgagtc

SEQ ID NO: 42656 - DNA, 15 bp, Homo sapiens
aaattgtttgagtcc

SEQ ID NO: 42657 - DNA, 15 bp, Homo sapiens
aattgtttgagtcca

SEQ ID NO: 42658 - DNA, 15 bp, Homo sapiens
attgtttgagtccac

SEQ ID NO: 42659 - DNA, 15 bp, Homo sapiens
ttgtttgagtccacg

SEQ ID NO: 42660 - DNA, 15 bp, Homo sapiens
tgtttgagtccacga

SEQ ID NO: 42661 - DNA, 15 bp, Homo sapiens
gtttgagtccacgag

SEQ ID NO: 42662 - DNA, 15 bp, Homo sapiens
tttgagtccacgagt

SEQ ID NO: 42663 - DNA, 15 bp, Homo sapiens
ttgagtccacgagtt

SEQ ID NO: 42664 - DNA, 15 bp, Homo sapiens
tgagtccacgagttg

SEQ ID NO: 42665 - DNA, 15 bp, Homo sapiens
gagtccacgagttgg

SEQ ID NO: 42666 - DNA, 15 bp, Homo sapiens
agtccacgagttgga

SEQ ID NO: 42667 - DNA, 15 bp, Homo sapiens
gtccacgagttggag

SEQ ID NO: 42668 - DNA, 15 bp, Homo sapiens
tccacgagttggaga

SEQ ID NO: 42669 - DNA, 15 bp, Homo sapiens
ccacgagttggagac

SEQ ID NO: 42670 - DNA, 15 bp, Homo sapiens
cacgagttggagacc

SEQ ID NO: 42671 - DNA, 15 bp, Homo sapiens
acgagttggagacca

SEQ ID NO: 42672 - DNA, 15 bp, Homo sapiens
cgagttggagaccac

SEQ ID NO: 42673 - DNA, 15 bp, Homo sapiens
gagttggagaccacc

SEQ ID NO: 42674 - DNA, 15 bp, Homo sapiens
agttggagaccaccc

SEQ ID NO: 42675 - DNA, 15 bp, Homo sapiens
gttggagaccaccct

SEQ ID NO: 42676 - DNA, 15 bp, Homo sapiens
ttggagaccaccctg

SEQ ID NO: 42677 - DNA, 15 bp, Homo sapiens
tggagaccaccctgg

SEQ ID NO: 42678 - DNA, 15 bp, Homo sapiens
ggagaccaccctggg

SEQ ID NO: 42679 - DNA, 15 bp, Homo sapiens
gagaccaccctgggc

SEQ ID NO: 42680 - DNA, 15 bp, Homo sapiens
agaccaccctgggca

SEQ ID NO: 42681 - DNA, 15 bp, Homo sapiens
gaccaccctgggcaa

SEQ ID NO: 42682 - DNA, 15 bp, Homo sapiens
accaccctgggcaac

SEQ ID NO: 42683 - DNA, 15 bp, Homo sapiens
ccaccctgggcaaca

SEQ ID NO: 42684 - DNA, 15 bp, Homo sapiens
caccctgggcaacat

SEQ ID NO: 42685 - DNA, 15 bp, Homo sapiens
accctgggcaacatg

SEQ ID NO: 42686 - DNA, 15 bp, Homo sapiens
ccctgggcaacatgg

SEQ ID NO: 42687 - DNA, 15 bp, Homo sapiens
cctgggcaacatggt

SEQ ID NO: 42688 - DNA, 15 bp, Homo sapiens
ctgggcaacatggta

SEQ ID NO: 42689 - DNA, 15 bp, Homo sapiens
tgggcaacatggtaa

SEQ ID NO: 42690 - DNA, 15 bp, Homo sapiens
gggcaacatggtaaa

SEQ ID NO: 42691 - DNA, 15 bp, Homo sapiens
ggcaacatggtaaaa

SEQ ID NO: 42692 - DNA, 15 bp, Homo sapiens
gcaacatggtaaaac

SEQ ID NO: 42693 - DNA, 15 bp, Homo sapiens
caacatggtaaaacc

SEQ ID NO: 42694 - DNA, 15 bp, Homo sapiens
aacatggtaaaacct

SEQ ID NO: 42695 - DNA, 15 bp, Homo sapiens
acatggtaaaacctc

SEQ ID NO: 42696 - DNA, 15 bp, Homo sapiens
catggtaaaacctca

SEQ ID NO: 42697 - DNA, 15 bp, Homo sapiens
atggtaaaacctcat

SEQ ID NO: 42698 - DNA, 15 bp, Homo sapiens
tggtaaaacctcatc

SEQ ID NO: 42699 - DNA, 15 bp, Homo sapiens
ggtaaaacctcatct

SEQ ID NO: 42700 - DNA, 15 bp, Homo sapiens
gtaaaacctcatctc

SEQ ID NO: 42701 - DNA, 15 bp, Homo sapiens
taaaacctcatctct

SEQ ID NO: 42702 - DNA, 15 bp, Homo sapiens
aaaacctcatctcta

SEQ ID NO: 42703 - DNA, 15 bp, Homo sapiens
aacctcatctctaca

SEQ ID NO: 42704 - DNA, 15 bp, Homo sapiens
acctcatctctacaa

SEQ ID NO: 42705 - DNA, 15 bp, Homo sapiens
cctcatctctacaaa

SEQ ID NO: 42706 - DNA, 15 bp, Homo sapiens
ctcatctctacaaaa

SEQ ID NO: 42707 - DNA, 15 bp, Homo sapiens
tcatctctacaaaaa

SEQ ID NO: 42708 - DNA, 15 bp, Homo sapiens
atctctacaaaaaaa

SEQ ID NO: 42709 - DNA, 15 bp, Homo sapiens
tctctacaaaaaaat

SEQ ID NO: 42710 - DNA, 15 bp, Homo sapiens
ctctacaaaaaaata

SEQ ID NO: 42711 - DNA, 15 bp, Homo sapiens
tctacaaaaaaatac

SEQ ID NO: 42712 - DNA, 15 bp, Homo sapiens
ctacaaaaaaatacc

SEQ ID NO: 42713 - DNA, 15 bp, Homo sapiens
tacaaaaaaatacca

SEQ ID NO: 42714 - DNA, 15 bp, Homo sapiens
acaaaaaaataccaa

SEQ ID NO: 42715 - DNA, 15 bp, Homo sapiens
caaaaaaataccaaa

SEQ ID NO: 42716 - DNA, 15 bp, Homo sapiens
aaaaaaataccaaaa

SEQ ID NO: 42717 - DNA, 15 bp, Homo sapiens
aaaaaataccaaaaa

SEQ ID NO: 42718 - DNA, 15 bp, Homo sapiens
aaaaataccaaaaaa

SEQ ID NO: 42719 - DNA, 15 bp, Homo sapiens
aaaataccaaaaaaa

SEQ ID NO: 42720 - DNA, 15 bp, Homo sapiens
aaataccaaaaaaat

SEQ ID NO: 42721 - DNA, 15 bp, Homo sapiens
aataccaaaaaaatt

SEQ ID NO: 42722 - DNA, 15 bp, Homo sapiens
ataccaaaaaaatta

SEQ ID NO: 42723 - DNA, 15 bp, Homo sapiens
taccaaaaaaattaa

SEQ ID NO: 42724 - DNA, 15 bp, Homo sapiens
accaaaaaaattaac

SEQ ID NO: 42725 - DNA, 15 bp, Homo sapiens
ccaaaaaaattaacc

SEQ ID NO: 42726 - DNA, 15 bp, Homo sapiens
caaaaaaattaaccc

SEQ ID NO: 42727 - DNA, 15 bp, Homo sapiens
aaaaaaattaacccg

SEQ ID NO: 42728 - DNA, 15 bp, Homo sapiens
aaaaaattaacccgg

SEQ ID NO: 42729 - DNA, 15 bp, Homo sapiens
aaaaattaacccggc

SEQ ID NO: 42730 - DNA, 15 bp, Homo sapiens
aaaattaacccggcg

SEQ ID NO: 42731 - DNA, 15 bp, Homo sapiens
aaattaacccggcgt

SEQ ID NO: 42732 - DNA, 15 bp, Homo sapiens
aattaacccggcgtg

SEQ ID NO: 42733 - DNA, 15 bp, Homo sapiens
attaacccggcgtgg

SEQ ID NO: 42734 - DNA, 15 bp, Homo sapiens
ttaacccggcgtggt

SEQ ID NO: 42735 - DNA, 15 bp, Homo sapiens
taacccggcgtggta

SEQ ID NO: 42736 - DNA, 15 bp, Homo sapiens
aacccggcgtggtat

SEQ ID NO: 42737 - DNA, 15 bp, Homo sapiens
acccggcgtggtatt

SEQ ID NO: 42738 - DNA, 15 bp, Homo sapiens
cccggcgtggtattg

SEQ ID NO: 42739 - DNA, 15 bp, Homo sapiens
ccggcgtggtattgg

SEQ ID NO: 42740 - DNA, 15 bp, Homo sapiens
cggcgtggtattggg

SEQ ID NO: 42741 - DNA, 15 bp, Homo sapiens
ggcgtggtattgggt

SEQ ID NO: 42742 - DNA, 15 bp, Homo sapiens
gcgtggtattgggtg

SEQ ID NO: 42743 - DNA, 15 bp, Homo sapiens
cgtggtattgggtgc

SEQ ID NO: 42744 - DNA, 15 bp, Homo sapiens
gtggtattgggtgcc

SEQ ID NO: 42745 - DNA, 15 bp, Homo sapiens
tggtattgggtgcct

SEQ ID NO: 42746 - DNA, 15 bp, Homo sapiens
ggtattgggtgcctg

SEQ ID NO: 42747 - DNA, 15 bp, Homo sapiens
gtattgggtgcctgt

SEQ ID NO: 42748 - DNA, 15 bp, Homo sapiens
tattgggtgcctgta

SEQ ID NO: 42749 - DNA, 15 bp, Homo sapiens
attgggtgcctgtaa

SEQ ID NO: 42750 - DNA, 15 bp, Homo sapiens
ttgggtgcctgtaat

SEQ ID NO: 42751 - DNA, 15 bp, Homo sapiens
tgggtgcctgtaatc

SEQ ID NO: 42752 - DNA, 15 bp, Homo sapiens
gggtgcctgtaatcc

SEQ ID NO: 42753 - DNA, 15 bp, Homo sapiens
ggtgcctgtaatccc

SEQ ID NO: 42754 - DNA, 15 bp, Homo sapiens
gtgcctgtaatccca

SEQ ID NO: 42755 - DNA, 15 bp, Homo sapiens
tgtaatcccagctat

SEQ ID NO: 42756 - DNA, 15 bp, Homo sapiens
gtaatcccagctatt

SEQ ID NO: 42757 - DNA, 15 bp, Homo sapiens
taatcccagctattc

SEQ ID NO: 42758 - DNA, 15 bp, Homo sapiens
aatcccagctattca

SEQ ID NO: 42759 - DNA, 15 bp, Homo sapiens
atcccagctattcag

SEQ ID NO: 42760 - DNA, 15 bp, Homo sapiens
tcccagctattcagg

SEQ ID NO: 42761 - DNA, 15 bp, Homo sapiens
cccagctattcagga

SEQ ID NO: 42762 - DNA, 15 bp, Homo sapiens
ccagctattcaggaa

SEQ ID NO: 42763 - DNA, 15 bp, Homo sapiens
cagctattcaggaag

SEQ ID NO: 42764 - DNA, 15 bp, Homo sapiens
agctattcaggaagc

SEQ ID NO: 42765 - DNA, 15 bp, Homo sapiens
gctattcaggaagcc

SEQ ID NO: 42766 - DNA, 15 bp, Homo sapiens
ctattcaggaagcca

SEQ ID NO: 42767 - DNA, 15 bp, Homo sapiens
tattcaggaagccaa

SEQ ID NO: 42768 - DNA, 15 bp, Homo sapiens
attcaggaagccaag

SEQ ID NO: 42769 - DNA, 15 bp, Homo sapiens
ttcaggaagccaagt

SEQ ID NO: 42770 - DNA, 15 bp, Homo sapiens
tcaggaagccaagtt

SEQ ID NO: 42771 - DNA, 15 bp, Homo sapiens
caggaagccaagttg

SEQ ID NO: 42772 - DNA, 15 bp, Homo sapiens
aggaagccaagttgg

SEQ ID NO: 42773 - DNA, 15 bp, Homo sapiens
ggaagccaagttggg

SEQ ID NO: 42774 - DNA, 15 bp, Homo sapiens
gaagccaagttggga

SEQ ID NO: 42775 - DNA, 15 bp, Homo sapiens
aagccaagttgggaa

SEQ ID NO: 42776 - DNA, 15 bp, Homo sapiens
agccaagttgggaag

SEQ ID NO: 42777 - DNA, 15 bp, Homo sapiens
gccaagttgggaaga

SEQ ID NO: 42778 - DNA, 15 bp, Homo sapiens
ccaagttgggaagat

SEQ ID NO: 42779 - DNA, 15 bp, Homo sapiens
caagttgggaagatt

SEQ ID NO: 42780 - DNA, 15 bp, Homo sapiens
aagttgggaagattg

SEQ ID NO: 42781 - DNA, 15 bp, Homo sapiens
agttgggaagattgc

SEQ ID NO: 42782 - DNA, 15 bp, Homo sapiens
gttgggaagattgct

SEQ ID NO: 42783 - DNA, 15 bp, Homo sapiens
ttgggaagattgctt

SEQ ID NO: 42784 - DNA, 15 bp, Homo sapiens
tgggaagattgcttg

SEQ ID NO: 42785 - DNA, 15 bp, Homo sapiens
ggaagattgcttgag

SEQ ID NO: 42786 - DNA, 15 bp, Homo sapiens
gaagattgcttgagc

SEQ ID NO: 42787 - DNA, 15 bp, Homo sapiens
aagattgcttgagcc

SEQ ID NO: 42788 - DNA, 15 bp, Homo sapiens
agattgcttgagccc

SEQ ID NO: 42789 - DNA, 15 bp, Homo sapiens
gattgcttgagccca

SEQ ID NO: 42790 - DNA, 15 bp, Homo sapiens
attgcttgagcccag

SEQ ID NO: 42791 - DNA, 15 bp, Homo sapiens
ttgcttgagcccagg

SEQ ID NO: 42792 - DNA, 15 bp, Homo sapiens
tgcttgagcccagga

SEQ ID NO: 42793 - DNA, 15 bp, Homo sapiens
gcttgagcccaggaa

SEQ ID NO: 42794 - DNA, 15 bp, Homo sapiens
cttgagcccaggaag

SEQ ID NO: 42795 - DNA, 15 bp, Homo sapiens
ttgagcccaggaagt

SEQ ID NO: 42796 - DNA, 15 bp, Homo sapiens
tgagcccaggaagtt

SEQ ID NO: 42797 - DNA, 15 bp, Homo sapiens
gagcccaggaagttg

SEQ ID NO: 42798 - DNA, 15 bp, Homo sapiens
agcccaggaagttga

SEQ ID NO: 42799 - DNA, 15 bp, Homo sapiens
gcccaggaagttgag

SEQ ID NO: 42800 - DNA, 15 bp, Homo sapiens
cccaggaagttgagg

SEQ ID NO: 42801 - DNA, 15 bp, Homo sapiens
ccaggaagttgaggc

SEQ ID NO: 42802 - DNA, 15 bp, Homo sapiens
caggaagttgaggct

SEQ ID NO: 42803 - DNA, 15 bp, Homo sapiens
aggaagttgaggctg

SEQ ID NO: 42804 - DNA, 15 bp, Homo sapiens
ggaagttgaggctgt

SEQ ID NO: 42805 - DNA, 15 bp, Homo sapiens
gaagttgaggctgta

SEQ ID NO: 42806 - DNA, 15 bp, Homo sapiens
aagttgaggctgtag

SEQ ID NO: 42807 - DNA, 15 bp, Homo sapiens
agttgaggctgtagt

SEQ ID NO: 42808 - DNA, 15 bp, Homo sapiens
gttgaggctgtagtg

SEQ ID NO: 42809 - DNA, 15 bp, Homo sapiens
ttgaggctgtagtga

SEQ ID NO: 42810 - DNA, 15 bp, Homo sapiens
tgaggctgtagtgag

SEQ ID NO: 42811 - DNA, 15 bp, Homo sapiens
gaggctgtagtgagt

SEQ ID NO: 42812 - DNA, 15 bp, Homo sapiens
aggctgtagtgagtt

SEQ ID NO: 42813 - DNA, 15 bp, Homo sapiens
ggctgtagtgagttg

SEQ ID NO: 42814 - DNA, 15 bp, Homo sapiens
gctgtagtgagttgt

SEQ ID NO: 42815 - DNA, 15 bp, Homo sapiens
ctgtagtgagttgtg

SEQ ID NO: 42816 - DNA, 15 bp, Homo sapiens
tgtagtgagttgtga

SEQ ID NO: 42817 - DNA, 15 bp, Homo sapiens
gtagtgagttgtgat

SEQ ID NO: 42818 - DNA, 15 bp, Homo sapiens
tagtgagttgtgatg

SEQ ID NO: 42819 - DNA, 15 bp, Homo sapiens
agtgagttgtgatgg

SEQ ID NO: 42820 - DNA, 15 bp, Homo sapiens
gtgagttgtgatggt

SEQ ID NO: 42821 - DNA, 15 bp, Homo sapiens
tgagttgtgatggtg

SEQ ID NO: 42822 - DNA, 15 bp, Homo sapiens
gagttgtgatggtgc

SEQ ID NO: 42823 - DNA, 15 bp, Homo sapiens
agttgtgatggtgcc

SEQ ID NO: 42824 - DNA, 15 bp, Homo sapiens
gttgtgatggtgcca

SEQ ID NO: 42825 - DNA, 15 bp, Homo sapiens
ttgtgatggtgccat

SEQ ID NO: 42826 - DNA, 15 bp, Homo sapiens
tgtgatggtgccatt

SEQ ID NO: 42827 - DNA, 15 bp, Homo sapiens
gtgatggtgccattg

SEQ ID NO: 42828 - DNA, 15 bp, Homo sapiens
tgatggtgccattgc

SEQ ID NO: 42829 - DNA, 15 bp, Homo sapiens
gatggtgccattgca

SEQ ID NO: 42830 - DNA, 15 bp, Homo sapiens
atggtgccattgcac

SEQ ID NO: 42831 - DNA, 15 bp, Homo sapiens
tggtgccattgcacc

SEQ ID NO: 42832 - DNA, 15 bp, Homo sapiens
ggtgccattgcacca

SEQ ID NO: 42833 - DNA, 15 bp, Homo sapiens
gtgccattgcaccag

SEQ ID NO: 42834 - DNA, 15 bp, Homo sapiens
tgccattgcaccagc

SEQ ID NO: 42835 - DNA, 15 bp, Homo sapiens
gccattgcaccagcc

SEQ ID NO: 42836 - DNA, 15 bp, Homo sapiens
ccattgcaccagccc

SEQ ID NO: 42837 - DNA, 15 bp, Homo sapiens
cattgcaccagcccg

SEQ ID NO: 42838 - DNA, 15 bp, Homo sapiens
attgcaccagcccgg

SEQ ID NO: 42839 - DNA, 15 bp, Homo sapiens
ttgcaccagcccggg

SEQ ID NO: 42840 - DNA, 15 bp, Homo sapiens
tgcaccagcccgggt

SEQ ID NO: 42841 - DNA, 15 bp, Homo sapiens
gcaccagcccgggtg

SEQ ID NO: 42842 - DNA, 15 bp, Homo sapiens
caccagcccgggtga

SEQ ID NO: 42843 - DNA, 15 bp, Homo sapiens
accagcccgggtgat

SEQ ID NO: 42844 - DNA, 15 bp, Homo sapiens
ccagcccgggtgata

SEQ ID NO: 42845 - DNA, 15 bp, Homo sapiens
cagcccgggtgatag

SEQ ID NO: 42846 - DNA, 15 bp, Homo sapiens
agcccgggtgataga

SEQ ID NO: 42847 - DNA, 15 bp, Homo sapiens
gcccgggtgatagag

SEQ ID NO: 42848 - DNA, 15 bp, Homo sapiens
cccgggtgatagagc

SEQ ID NO: 42849 - DNA, 15 bp, Homo sapiens
ccgggtgatagagca

SEQ ID NO: 42850 - DNA, 15 bp, Homo sapiens
cgggtgatagagcaa

SEQ ID NO: 42851 - DNA, 15 bp, Homo sapiens
tgatagagcaagacc

SEQ ID NO: 42852 - DNA, 15 bp, Homo sapiens
gatagagcaagacct

SEQ ID NO: 42853 - DNA, 15 bp, Homo sapiens
atagagcaagacctc

SEQ ID NO: 42854 - DNA, 15 bp, Homo sapiens
tagagcaagacctct

SEQ ID NO: 42855 - DNA, 15 bp, Homo sapiens
agagcaagacctctg

SEQ ID NO: 42856 - DNA, 15 bp, Homo sapiens
gagcaagacctctgt

SEQ ID NO: 42857 - DNA, 15 bp, Homo sapiens
agcaagacctctgtc

SEQ ID NO: 42858 - DNA, 15 bp, Homo sapiens
gcaagacctctgtct

SEQ ID NO: 42859 - DNA, 15 bp, Homo sapiens
caagacctctgtctc

SEQ ID NO: 42860 - DNA, 15 bp, Homo sapiens
aagacctctgtctcg

SEQ ID NO: 42861 - DNA, 15 bp, Homo sapiens
agacctctgtctcga

SEQ ID NO: 42862 - DNA, 15 bp, Homo sapiens
gacctctgtctcgaa

SEQ ID NO: 42863 - DNA, 15 bp, Homo sapiens
acctctgtctcgaaa

SEQ ID NO: 42864 - DNA, 15 bp, Homo sapiens
cctctgtctcgaaaa

SEQ ID NO: 42865 - DNA, 15 bp, Homo sapiens
ctctgtctcgaaaaa

SEQ ID NO: 42866 - DNA, 15 bp, Homo sapiens
tctgtctcgaaaaaa

SEQ ID NO: 42867 - DNA, 15 bp, Homo sapiens
ctgtctcgaaaaaaa

SEQ ID NO: 42868 - DNA, 15 bp, Homo sapiens
tgtctcgaaaaaaaa

SEQ ID NO: 42869 - DNA, 15 bp, Homo sapiens
gtctcgaaaaaaaaa

SEQ ID NO: 42870 - DNA, 15 bp, Homo sapiens
tctcgaaaaaaaaaa

SEQ ID NO: 42871 - DNA, 15 bp, Homo sapiens
ctcgaaaaaaaaaaa

SEQ ID NO: 42872 - DNA, 15 bp, Homo sapiens
tcgaaaaaaaaaaaa

SEQ ID NO: 42873 - DNA, 15 bp, Homo sapiens
cgaaaaaaaaaaaaa

SEQ ID NO: 42874 - DNA, 15 bp, Homo sapiens
aaaaaaaaaaagtat

SEQ ID NO: 42875 - DNA, 15 bp, Homo sapiens
aaaaaaaaaagtatc

SEQ ID NO: 42876 - DNA, 15 bp, Homo sapiens
aaaaaaaaagtatca

SEQ ID NO: 42877 - DNA, 15 bp, Homo sapiens
aaaaaaaagtatcag

SEQ ID NO: 42878 - DNA, 15 bp, Homo sapiens
aaaaaaagtatcagt

SEQ ID NO: 42879 - DNA, 15 bp, Homo sapiens
aaaaaagtatcagta

SEQ ID NO: 42880 - DNA, 15 bp, Homo sapiens
aaaaagtatcagtat

SEQ ID NO: 42881 - DNA, 15 bp, Homo sapiens
aaaagtatcagtata

SEQ ID NO: 42882 - DNA, 15 bp, Homo sapiens
aaagtatcagtatat

SEQ ID NO: 42883 - DNA, 15 bp, Homo sapiens
aagtatcagtatata

SEQ ID NO: 42884 - DNA, 15 bp, Homo sapiens
agtatcagtatatat

SEQ ID NO: 42885 - DNA, 15 bp, Homo sapiens
gtatcagtatatatg

SEQ ID NO: 42886 - DNA, 15 bp, Homo sapiens
tatcagtatatatgt

SEQ ID NO: 42887 - DNA, 15 bp, Homo sapiens
atcagtatatatgtt

SEQ ID NO: 42888 - DNA, 15 bp, Homo sapiens
tcagtatatatgtta

SEQ ID NO: 42889 - DNA, 15 bp, Homo sapiens
cagtatatatgttaa

SEQ ID NO: 42890 - DNA, 15 bp, Homo sapiens
agtatatatgttaaa

SEQ ID NO: 42891 - DNA, 15 bp, Homo sapiens
gtatatatgttaaag

SEQ ID NO: 42892 - DNA, 15 bp, Homo sapiens
tatatatgttaaagt

SEQ ID NO: 42893 - DNA, 15 bp, Homo sapiens
atatatgttaaagta

SEQ ID NO: 42894 - DNA, 15 bp, Homo sapiens
tatatgttaaagtat

SEQ ID NO: 42895 - DNA, 15 bp, Homo sapiens
atatgttaaagtatt

SEQ ID NO: 42896 - DNA, 15 bp, Homo sapiens
tatgttaaagtattt

SEQ ID NO: 42897 - DNA, 15 bp, Homo sapiens
atgttaaagtattta

SEQ ID NO: 42898 - DNA, 15 bp, Homo sapiens
tgttaaagtatttat

SEQ ID NO: 42899 - DNA, 15 bp, Homo sapiens
gttaaagtatttatt

SEQ ID NO: 42900 - DNA, 15 bp, Homo sapiens
ttaaagtatttatta

SEQ ID NO: 42901 - DNA, 15 bp, Homo sapiens
taaagtatttattaa

SEQ ID NO: 42902 - DNA, 15 bp, Homo sapiens
aaagtatttattaaa

SEQ ID NO: 42903 - DNA, 15 bp, Homo sapiens
aagtatttattaaag

SEQ ID NO: 42904 - DNA, 15 bp, Homo sapiens
agtatttattaaagt

SEQ ID NO: 42905 - DNA, 15 bp, Homo sapiens
gtatttattaaagta

SEQ ID NO: 42906 - DNA, 15 bp, Homo sapiens
tatttattaaagtat

SEQ ID NO: 42907 - DNA, 15 bp, Homo sapiens
atttattaaagtata

SEQ ID NO: 42908 - DNA, 15 bp, Homo sapiens
tttattaaagtatac

SEQ ID NO: 42909 - DNA, 15 bp, Homo sapiens
ttattaaagtataca

SEQ ID NO: 42910 - DNA, 15 bp, Homo sapiens
tattaaagtatacaa

SEQ ID NO: 42911 - DNA, 15 bp, Homo sapiens
attaaagtatacaac

SEQ ID NO: 42912 - DNA, 15 bp, Homo sapiens
ttaaagtatacaaca

SEQ ID NO: 42913 - DNA, 15 bp, Homo sapiens
taaagtatacaacaa

SEQ ID NO: 42914 - DNA, 15 bp, Homo sapiens
aaagtatacaacaaa

SEQ ID NO: 42915 - DNA, 15 bp, Homo sapiens
aagtatacaacaaat

SEQ ID NO: 42916 - DNA, 15 bp, Homo sapiens
agtatacaacaaata

SEQ ID NO: 42917 - DNA, 15 bp, Homo sapiens
gtatacaacaaatat

SEQ ID NO: 42918 - DNA, 15 bp, Homo sapiens
tatacaacaaatata

SEQ ID NO: 42919 - DNA, 15 bp, Homo sapiens
atacaacaaatatat

SEQ ID NO: 42920 - DNA, 15 bp, Homo sapiens
tacaacaaatatatg

SEQ ID NO: 42921 - DNA, 15 bp, Homo sapiens
acaacaaatatatgt

SEQ ID NO: 42922 - DNA, 15 bp, Homo sapiens
caacaaatatatgta

SEQ ID NO: 42923 - DNA, 15 bp, Homo sapiens
aacaaatatatgtaa

SEQ ID NO: 42924 - DNA, 15 bp, Homo sapiens
acaaatatatgtaaa

SEQ ID NO: 42925 - DNA, 15 bp, Homo sapiens
caaatatatgtaaat

SEQ ID NO: 42926 - DNA, 15 bp, Homo sapiens
aaatatatgtaaata

SEQ ID NO: 42927 - DNA, 15 bp, Homo sapiens
aatatatgtaaataa

SEQ ID NO: 42928 - DNA, 15 bp, Homo sapiens
atatatgtaaataat

SEQ ID NO: 42929 - DNA, 15 bp, Homo sapiens
tatatgtaaataata

SEQ ID NO: 42930 - DNA, 15 bp, Homo sapiens
atatgtaaataatac

SEQ ID NO: 42931 - DNA, 15 bp, Homo sapiens
tatgtaaataataca

SEQ ID NO: 42932 - DNA, 15 bp, Homo sapiens
atgtaaataatacag

SEQ ID NO: 42933 - DNA, 15 bp, Homo sapiens
tgtaaataatacagt

SEQ ID NO: 42934 - DNA, 15 bp, Homo sapiens
gtaaataatacagtc

SEQ ID NO: 42935 - DNA, 15 bp, Homo sapiens
taaataatacagtca

SEQ ID NO: 42936 - DNA, 15 bp, Homo sapiens
aaataatacagtcac

SEQ ID NO: 42937 - DNA, 15 bp, Homo sapiens
aataatacagtcaca

SEQ ID NO: 42938 - DNA, 15 bp, Homo sapiens
ataatacagtcacag

SEQ ID NO: 42939 - DNA, 15 bp, Homo sapiens
taatacagtcacagt

SEQ ID NO: 42940 - DNA, 15 bp, Homo sapiens
aatacagtcacagta

SEQ ID NO: 42941 - DNA, 15 bp, Homo sapiens
atacagtcacagtat

SEQ ID NO: 42942 - DNA, 15 bp, Homo sapiens
tacagtcacagtatc

SEQ ID NO: 42943 - DNA, 15 bp, Homo sapiens
acagtcacagtatca

SEQ ID NO: 42944 - DNA, 15 bp, Homo sapiens
cagtcacagtatcag

SEQ ID NO: 42945 - DNA, 15 bp, Homo sapiens
agtcacagtatcaga

SEQ ID NO: 42946 - DNA, 15 bp, Homo sapiens
gtcacagtatcagag

SEQ ID NO: 42947 - DNA, 15 bp, Homo sapiens
tcacagtatcagagt

SEQ ID NO: 42948 - DNA, 15 bp, Homo sapiens
cacagtatcagagta

SEQ ID NO: 42949 - DNA, 15 bp, Homo sapiens
acagtatcagagtat

SEQ ID NO: 42950 - DNA, 15 bp, Homo sapiens
cagtatcagagtata

SEQ ID NO: 42951 - DNA, 15 bp, Homo sapiens
agtatcagagtataa

SEQ ID NO: 42952 - DNA, 15 bp, Homo sapiens
gtatcagagtataaa

SEQ ID NO: 42953 - DNA, 15 bp, Homo sapiens
tatcagagtataaaa

SEQ ID NO: 42954 - DNA, 15 bp, Homo sapiens
atcagagtataaaat

SEQ ID NO: 42955 - DNA, 15 bp, Homo sapiens
tcagagtataaaatg

SEQ ID NO: 42956 - DNA, 15 bp, Homo sapiens
cagagtataaaatga

SEQ ID NO: 42957 - DNA, 15 bp, Homo sapiens
agagtataaaatgat

SEQ ID NO: 42958 - DNA, 15 bp, Homo sapiens
gagtataaaatgatt

SEQ ID NO: 42959 - DNA, 15 bp, Homo sapiens
agtataaaatgatta

SEQ ID NO: 42960 - DNA, 15 bp, Homo sapiens
gtataaaatgattac

SEQ ID NO: 42961 - DNA, 15 bp, Homo sapiens
tataaaatgattact

SEQ ID NO: 42962 - DNA, 15 bp, Homo sapiens
ataaaatgattactg

SEQ ID NO: 42963 - DNA, 15 bp, Homo sapiens
taaaatgattactga

SEQ ID NO: 42964 - DNA, 15 bp, Homo sapiens
aaaatgattactgaa

SEQ ID NO: 42965 - DNA, 15 bp, Homo sapiens
aaatgattactgaaa

SEQ ID NO: 42966 - DNA, 15 bp, Homo sapiens
aatgattactgaaaa

SEQ ID NO: 42967 - DNA, 15 bp, Homo sapiens
atgattactgaaaaa

SEQ ID NO: 42968 - DNA, 15 bp, Homo sapiens
tgattactgaaaaat

SEQ ID NO: 42969 - DNA, 15 bp, Homo sapiens
gattactgaaaaata

SEQ ID NO: 42970 - DNA, 15 bp, Homo sapiens
attactgaaaaataa

SEQ ID NO: 42971 - DNA, 15 bp, Homo sapiens
ttactgaaaaataaa

SEQ ID NO: 42972 - DNA, 15 bp, Homo sapiens
tactgaaaaataaat

SEQ ID NO: 42973 - DNA, 15 bp, Homo sapiens
actgaaaaataaatt

SEQ ID NO: 42974 - DNA, 15 bp, Homo sapiens
ctgaaaaataaatta

SEQ ID NO: 42975 - DNA, 15 bp, Homo sapiens
tgaaaaataaattaa

SEQ ID NO: 42976 - DNA, 15 bp, Homo sapiens
gaaaaataaattaat

SEQ ID NO: 42977 - DNA, 15 bp, Homo sapiens
aaaaataaattaatt

SEQ ID NO: 42978 - DNA, 15 bp, Homo sapiens
aaaataaattaattt

SEQ ID NO: 42979 - DNA, 15 bp, Homo sapiens
aaataaattaatttg

SEQ ID NO: 42980 - DNA, 15 bp, Homo sapiens
aataaattaatttga

SEQ ID NO: 42981 - DNA, 15 bp, Homo sapiens
ataaattaatttgaa

SEQ ID NO: 42982 - DNA, 15 bp, Homo sapiens
taaattaatttgaat

SEQ ID NO: 42983 - DNA, 15 bp, Homo sapiens
aaattaatttgaata

SEQ ID NO: 42984 - DNA, 15 bp, Homo sapiens
aattaatttgaatag

SEQ ID NO: 42985 - DNA, 15 bp, Homo sapiens
attaatttgaatagt

SEQ ID NO: 42986 - DNA, 15 bp, Homo sapiens
ttaatttgaatagtt

SEQ ID NO: 42987 - DNA, 15 bp, Homo sapiens
taatttgaatagtta

SEQ ID NO: 42988 - DNA, 15 bp, Homo sapiens
aatttgaatagttac

SEQ ID NO: 42989 - DNA, 15 bp, Homo sapiens
atttgaatagttact

SEQ ID NO: 42990 - DNA, 15 bp, Homo sapiens
tttgaatagttactc

SEQ ID NO: 42991 - DNA, 15 bp, Homo sapiens
ttgaatagttactcc

SEQ ID NO: 42992 - DNA, 15 bp, Homo sapiens
tgaatagttactcca

SEQ ID NO: 42993 - DNA, 15 bp, Homo sapiens
gaatagttactccag

SEQ ID NO: 42994 - DNA, 15 bp, Homo sapiens
aatagttactccaga

SEQ ID NO: 42995 - DNA, 15 bp, Homo sapiens
atagttactccagaa

SEQ ID NO: 42996 - DNA, 15 bp, Homo sapiens
tagttactccagaaa

SEQ ID NO: 42997 - DNA, 15 bp, Homo sapiens
agttactccagaaaa

SEQ ID NO: 42998 - DNA, 15 bp, Homo sapiens
gttactccagaaaat

SEQ ID NO: 42999 - DNA, 15 bp, Homo sapiens
ttactccagaaaata

SEQ ID NO: 43000 - DNA, 15 bp, Homo sapiens
tactccagaaaataa

SEQ ID NO: 43001 - DNA, 15 bp, Homo sapiens
actccagaaaataat

SEQ ID NO: 43002 - DNA, 15 bp, Homo sapiens
ctccagaaaataatc

SEQ ID NO: 43003 - DNA, 15 bp, Homo sapiens
tccagaaaataatca

SEQ ID NO: 43004 - DNA, 15 bp, Homo sapiens
ccagaaaataatcaa

SEQ ID NO: 43005 - DNA, 15 bp, Homo sapiens
cagaaaataatcaat

SEQ ID NO: 43006 - DNA, 15 bp, Homo sapiens
agaaaataatcaatg

SEQ ID NO: 43007 - DNA, 15 bp, Homo sapiens
gaaaataatcaatgg

SEQ ID NO: 43008 - DNA, 15 bp, Homo sapiens
aaaataatcaatggg

SEQ ID NO: 43009 - DNA, 15 bp, Homo sapiens
aaataatcaatgggg

SEQ ID NO: 43010 - DNA, 15 bp, Homo sapiens
aataatcaatgggga

SEQ ID NO: 43011 - DNA, 15 bp, Homo sapiens
ataatcaatggggat

SEQ ID NO: 43012 - DNA, 15 bp, Homo sapiens
taatcaatggggatt

SEQ ID NO: 43013 - DNA, 15 bp, Homo sapiens
aatcaatggggattc

SEQ ID NO: 43014 - DNA, 15 bp, Homo sapiens
atcaatggggattct

SEQ ID NO: 43015 - DNA, 15 bp, Homo sapiens
tcaatggggattcta

SEQ ID NO: 43016 - DNA, 15 bp, Homo sapiens
caatggggattctac

SEQ ID NO: 43017 - DNA, 15 bp, Homo sapiens
aatggggattctact

SEQ ID NO: 43018 - DNA, 15 bp, Homo sapiens
atggggattctactt

SEQ ID NO: 43019 - DNA, 15 bp, Homo sapiens
tggggattctacttg

SEQ ID NO: 43020 - DNA, 15 bp, Homo sapiens
ggggattctacttga

SEQ ID NO: 43021 - DNA, 15 bp, Homo sapiens
gggattctacttgaa

SEQ ID NO: 43022 - DNA, 15 bp, Homo sapiens
ggattctacttgaaa

SEQ ID NO: 43023 - DNA, 15 bp, Homo sapiens
gattctacttgaaaa

SEQ ID NO: 43024 - DNA, 15 bp, Homo sapiens
attctacttgaaaat

SEQ ID NO: 43025 - DNA, 15 bp, Homo sapiens
ttctacttgaaaatt

SEQ ID NO: 43026 - DNA, 15 bp, Homo sapiens
tctacttgaaaattc

SEQ ID NO: 43027 - DNA, 15 bp, Homo sapiens
ctacttgaaaattca

SEQ ID NO: 43028 - DNA, 15 bp, Homo sapiens
tacttgaaaattcac

SEQ ID NO: 43029 - DNA, 15 bp, Homo sapiens
acttgaaaattcact

SEQ ID NO: 43030 - DNA, 15 bp, Homo sapiens
cttgaaaattcactt

SEQ ID NO: 43031 - DNA, 15 bp, Homo sapiens
ttgaaaattcacttt

SEQ ID NO: 43032 - DNA, 15 bp, Homo sapiens
tgaaaattcactttt

SEQ ID NO: 43033 - DNA, 15 bp, Homo sapiens
gaaaattcacttttt

SEQ ID NO: 43034 - DNA, 15 bp, Homo sapiens
aaaattcactttttt

SEQ ID NO: 43035 - DNA, 15 bp, Homo sapiens
aaattcactttttta

SEQ ID NO: 43036 - DNA, 15 bp, Homo sapiens
aattcacttttttat

SEQ ID NO: 43037 - DNA, 15 bp, Homo sapiens
attcacttttttatt

SEQ ID NO: 43038 - DNA, 15 bp, Homo sapiens
ttcacttttttattt

SEQ ID NO: 43039 - DNA, 15 bp, Homo sapiens
tcacttttttatttt

SEQ ID NO: 43040 - DNA, 15 bp, Homo sapiens
cacttttttattttg

SEQ ID NO: 43041 - DNA, 15 bp, Homo sapiens
acttttttattttgg

SEQ ID NO: 43042 - DNA, 15 bp, Homo sapiens
cttttttattttgga

SEQ ID NO: 43043 - DNA, 15 bp, Homo sapiens
ttttttattttggaa

SEQ ID NO: 43044 - DNA, 15 bp, Homo sapiens
tttttattttggaat

SEQ ID NO: 43045 - DNA, 15 bp, Homo sapiens
ttttattttggaatt

SEQ ID NO: 43046 - DNA, 15 bp, Homo sapiens
tttattttggaattg

SEQ ID NO: 43047 - DNA, 15 bp, Homo sapiens
ttattttggaattgt

SEQ ID NO: 43048 - DNA, 15 bp, Homo sapiens
tattttggaattgtg

SEQ ID NO: 43049 - DNA, 15 bp, Homo sapiens
attttggaattgtgt

SEQ ID NO: 43050 - DNA, 15 bp, Homo sapiens
ttttggaattgtgtt

SEQ ID NO: 43051 - DNA, 15 bp, Homo sapiens
tttggaattgtgttg

SEQ ID NO: 43052 - DNA, 15 bp, Homo sapiens
ttggaattgtgttga

SEQ ID NO: 43053 - DNA, 15 bp, Homo sapiens
tggaattgtgttgat

SEQ ID NO: 43054 - DNA, 15 bp, Homo sapiens
ggaattgtgttgatt

SEQ ID NO: 43055 - DNA, 15 bp, Homo sapiens
gaattgtgttgattt

SEQ ID NO: 43056 - DNA, 15 bp, Homo sapiens
aattgtgttgatttt

SEQ ID NO: 43057 - DNA, 15 bp, Homo sapiens
attgtgttgattttt

SEQ ID NO: 43058 - DNA, 15 bp, Homo sapiens
ttgtgttgattttta

SEQ ID NO: 43059 - DNA, 15 bp, Homo sapiens
tgtgttgatttttat

SEQ ID NO: 43060 - DNA, 15 bp, Homo sapiens
gtgttgatttttatc

SEQ ID NO: 43061 - DNA, 15 bp, Homo sapiens
tgttgatttttatcc

SEQ ID NO: 43062 - DNA, 15 bp, Homo sapiens
gttgatttttatcct

SEQ ID NO: 43063 - DNA, 15 bp, Homo sapiens
ttgatttttatcctg

SEQ ID NO: 43064 - DNA, 15 bp, Homo sapiens
tgatttttatcctga

SEQ ID NO: 43065 - DNA, 15 bp, Homo sapiens
gatttttatcctgac

SEQ ID NO: 43066 - DNA, 15 bp, Homo sapiens
atttttatcctgaca

SEQ ID NO: 43067 - DNA, 15 bp, Homo sapiens
tttttatcctgacac

SEQ ID NO: 43068 - DNA, 15 bp, Homo sapiens
ttttatcctgacacc

SEQ ID NO: 43069 - DNA, 15 bp, Homo sapiens
tttatcctgacaccc

SEQ ID NO: 43070 - DNA, 15 bp, Homo sapiens
ttatcctgacaccct

SEQ ID NO: 43071 - DNA, 15 bp, Homo sapiens
tatcctgacaccctt

SEQ ID NO: 43072 - DNA, 15 bp, Homo sapiens
atcctgacacccttt

SEQ ID NO: 43073 - DNA, 15 bp, Homo sapiens
tcctgacaccctttg

SEQ ID NO: 43074 - DNA, 15 bp, Homo sapiens
cctgacaccctttgt

SEQ ID NO: 43075 - DNA, 15 bp, Homo sapiens
ctgacaccctttgtt

SEQ ID NO: 43076 - DNA, 15 bp, Homo sapiens
tgacaccctttgttc

SEQ ID NO: 43077 - DNA, 15 bp, Homo sapiens
gacaccctttgttct

SEQ ID NO: 43078 - DNA, 15 bp, Homo sapiens
acaccctttgttctg

SEQ ID NO: 43079 - DNA, 15 bp, Homo sapiens
caccctttgttctgg

SEQ ID NO: 43080 - DNA, 15 bp, Homo sapiens
accctttgttctggt

SEQ ID NO: 43081 - DNA, 15 bp, Homo sapiens
ccctttgttctggta

SEQ ID NO: 43082 - DNA, 15 bp, Homo sapiens
cctttgttctggtat

SEQ ID NO: 43083 - DNA, 15 bp, Homo sapiens
ctttgttctggtatt

SEQ ID NO: 43084 - DNA, 15 bp, Homo sapiens
tttgttctggtatta

SEQ ID NO: 43085 - DNA, 15 bp, Homo sapiens
ttgttctggtattaa

SEQ ID NO: 43086 - DNA, 15 bp, Homo sapiens
tgttctggtattaat

SEQ ID NO: 43087 - DNA, 15 bp, Homo sapiens
gttctggtattaatt

SEQ ID NO: 43088 - DNA, 15 bp, Homo sapiens
ttctggtattaattt

SEQ ID NO: 43089 - DNA, 15 bp, Homo sapiens
tctggtattaatttc

SEQ ID NO: 43090 - DNA, 15 bp, Homo sapiens
ctggtattaatttcc

SEQ ID NO: 43091 - DNA, 15 bp, Homo sapiens
tggtattaatttcca

SEQ ID NO: 43092 - DNA, 15 bp, Homo sapiens
ggtattaatttccat

SEQ ID NO: 43093 - DNA, 15 bp, Homo sapiens
gtattaatttccatt

SEQ ID NO: 43094 - DNA, 15 bp, Homo sapiens
tattaatttccatta

SEQ ID NO: 43095 - DNA, 15 bp, Homo sapiens
attaatttccattac

SEQ ID NO: 43096 - DNA, 15 bp, Homo sapiens
ttaatttccattact

SEQ ID NO: 43097 - DNA, 15 bp, Homo sapiens
taatttccattacta

SEQ ID NO: 43098 - DNA, 15 bp, Homo sapiens
aatttccattactaa

SEQ ID NO: 43099 - DNA, 15 bp, Homo sapiens
atttccattactaag

SEQ ID NO: 43100 - DNA, 15 bp, Homo sapiens
tttccattactaagt

SEQ ID NO: 43101 - DNA, 15 bp, Homo sapiens
ttccattactaagtt

SEQ ID NO: 43102 - DNA, 15 bp, Homo sapiens
tccattactaagttt

SEQ ID NO: 43103 - DNA, 15 bp, Homo sapiens
ccattactaagtttt

SEQ ID NO: 43104 - DNA, 15 bp, Homo sapiens
cattactaagttttc

SEQ ID NO: 43105 - DNA, 15 bp, Homo sapiens
attactaagttttcc

SEQ ID NO: 43106 - DNA, 15 bp, Homo sapiens
ttactaagttttccc

SEQ ID NO: 43107 - DNA, 15 bp, Homo sapiens
tactaagttttccca

SEQ ID NO: 43108 - DNA, 15 bp, Homo sapiens
actaagttttcccag

SEQ ID NO: 43109 - DNA, 15 bp, Homo sapiens
ctaagttttcccagc

SEQ ID NO: 43110 - DNA, 15 bp, Homo sapiens
taagttttcccagct

SEQ ID NO: 43111 - DNA, 15 bp, Homo sapiens
aagttttcccagctt

SEQ ID NO: 43112 - DNA, 15 bp, Homo sapiens
agttttcccagctta

SEQ ID NO: 43113 - DNA, 15 bp, Homo sapiens
gttttcccagcttac

SEQ ID NO: 43114 - DNA, 15 bp, Homo sapiens
ttttcccagcttacc

SEQ ID NO: 43115 - DNA, 15 bp, Homo sapiens
tttcccagcttacct

SEQ ID NO: 43116 - DNA, 15 bp, Homo sapiens
ttcccagcttacctc

SEQ ID NO: 43117 - DNA, 15 bp, Homo sapiens
tcccagcttacctcc

SEQ ID NO: 43118 - DNA, 15 bp, Homo sapiens
cccagcttacctcct

SEQ ID NO: 43119 - DNA, 15 bp, Homo sapiens
ccagcttacctcctt

SEQ ID NO: 43120 - DNA, 15 bp, Homo sapiens
cagcttacctccttt

SEQ ID NO: 43121 - DNA, 15 bp, Homo sapiens
agcttacctcctttg

SEQ ID NO: 43122 - DNA, 15 bp, Homo sapiens
gcttacctcctttga

SEQ ID NO: 43123 - DNA, 15 bp, Homo sapiens
cttacctcctttgaa

SEQ ID NO: 43124 - DNA, 15 bp, Homo sapiens
ttacctcctttgaat

SEQ ID NO: 43125 - DNA, 15 bp, Homo sapiens
tacctcctttgaatg

SEQ ID NO: 43126 - DNA, 15 bp, Homo sapiens
acctcctttgaatga

SEQ ID NO: 43127 - DNA, 15 bp, Homo sapiens
cctcctttgaatgaa

SEQ ID NO: 43128 - DNA, 15 bp, Homo sapiens
ctcctttgaatgaat

SEQ ID NO: 43129 - DNA, 15 bp, Homo sapiens
tcctttgaatgaatt

SEQ ID NO: 43130 - DNA, 15 bp, Homo sapiens
cctttgaatgaattg

SEQ ID NO: 43131 - DNA, 15 bp, Homo sapiens
ctttgaatgaattgg

SEQ ID NO: 43132 - DNA, 15 bp, Homo sapiens
tttgaatgaattggg

SEQ ID NO: 43133 - DNA, 15 bp, Homo sapiens
ttgaatgaattgggc

SEQ ID NO: 43134 - DNA, 15 bp, Homo sapiens
tgaatgaattgggcc

SEQ ID NO: 43135 - DNA, 15 bp, Homo sapiens
gaatgaattgggcct

SEQ ID NO: 43136 - DNA, 15 bp, Homo sapiens
aatgaattgggcctt

SEQ ID NO: 43137 - DNA, 15 bp, Homo sapiens
atgaattgggccttt

SEQ ID NO: 43138 - DNA, 15 bp, Homo sapiens
tgaattgggcctttt

SEQ ID NO: 43139 - DNA, 15 bp, Homo sapiens
gaattgggccttttg

SEQ ID NO: 43140 - DNA, 15 bp, Homo sapiens
aattgggccttttgc

SEQ ID NO: 43141 - DNA, 15 bp, Homo sapiens
attgggccttttgcc

SEQ ID NO: 43142 - DNA, 15 bp, Homo sapiens
ttgggccttttgcca

SEQ ID NO: 43143 - DNA, 15 bp, Homo sapiens
tgggccttttgccaa

SEQ ID NO: 43144 - DNA, 15 bp, Homo sapiens
gggccttttgccaac

SEQ ID NO: 43145 - DNA, 15 bp, Homo sapiens
ggccttttgccaacc

SEQ ID NO: 43146 - DNA, 15 bp, Homo sapiens
gccttttgccaacct

SEQ ID NO: 43147 - DNA, 15 bp, Homo sapiens
ccttttgccaacctt

SEQ ID NO: 43148 - DNA, 15 bp, Homo sapiens
cttttgccaaccttt

SEQ ID NO: 43149 - DNA, 15 bp, Homo sapiens
ttttgccaacctttt

SEQ ID NO: 43150 - DNA, 15 bp, Homo sapiens
tttgccaaccttttc

SEQ ID NO: 43151 - DNA, 15 bp, Homo sapiens
ttgccaaccttttct

SEQ ID NO: 43152 - DNA, 15 bp, Homo sapiens
tgccaaccttttctc

SEQ ID NO: 43153 - DNA, 15 bp, Homo sapiens
gccaaccttttctca

SEQ ID NO: 43154 - DNA, 15 bp, Homo sapiens
ccaaccttttctcac

SEQ ID NO: 43155 - DNA, 15 bp, Homo sapiens
caaccttttctcaca

SEQ ID NO: 43156 - DNA, 15 bp, Homo sapiens
aaccttttctcacac

SEQ ID NO: 43157 - DNA, 15 bp, Homo sapiens
accttttctcacact

SEQ ID NO: 43158 - DNA, 15 bp, Homo sapiens
ccttttctcacacta

SEQ ID NO: 43159 - DNA, 15 bp, Homo sapiens
cttttctcacactaa

SEQ ID NO: 43160 - DNA, 15 bp, Homo sapiens
ttttctcacactaac

SEQ ID NO: 43161 - DNA, 15 bp, Homo sapiens
tttctcacactaaca

SEQ ID NO: 43162 - DNA, 15 bp, Homo sapiens
ttctcacactaacag

SEQ ID NO: 43163 - DNA, 15 bp, Homo sapiens
tctcacactaacagt

SEQ ID NO: 43164 - DNA, 15 bp, Homo sapiens
ctcacactaacagta

SEQ ID NO: 43165 - DNA, 15 bp, Homo sapiens
tcacactaacagtat

SEQ ID NO: 43166 - DNA, 15 bp, Homo sapiens
cacactaacagtatc

SEQ ID NO: 43167 - DNA, 15 bp, Homo sapiens
acactaacagtatcc

SEQ ID NO: 43168 - DNA, 15 bp, Homo sapiens
cactaacagtatccc

SEQ ID NO: 43169 - DNA, 15 bp, Homo sapiens
actaacagtatccca

SEQ ID NO: 43170 - DNA, 15 bp, Homo sapiens
ctaacagtatcccaa

SEQ ID NO: 43171 - DNA, 15 bp, Homo sapiens
taacagtatcccaag

SEQ ID NO: 43172 - DNA, 15 bp, Homo sapiens
aacagtatcccaaga

SEQ ID NO: 43173 - DNA, 15 bp, Homo sapiens
acagtatcccaagag

SEQ ID NO: 43174 - DNA, 15 bp, Homo sapiens
cagtatcccaagagt

SEQ ID NO: 43175 - DNA, 15 bp, Homo sapiens
agtatcccaagagtg

SEQ ID NO: 43176 - DNA, 15 bp, Homo sapiens
gtatcccaagagtgg

SEQ ID NO: 43177 - DNA, 15 bp, Homo sapiens
tatcccaagagtggt

SEQ ID NO: 43178 - DNA, 15 bp, Homo sapiens
atcccaagagtggta

SEQ ID NO: 43179 - DNA, 15 bp, Homo sapiens
tcccaagagtggtaa

SEQ ID NO: 43180 - DNA, 15 bp, Homo sapiens
cccaagagtggtaat

SEQ ID NO: 43181 - DNA, 15 bp, Homo sapiens
ccaagagtggtaatg

SEQ ID NO: 43182 - DNA, 15 bp, Homo sapiens
caagagtggtaatgg

SEQ ID NO: 43183 - DNA, 15 bp, Homo sapiens
aagagtggtaatggg

SEQ ID NO: 43184 - DNA, 15 bp, Homo sapiens
agagtggtaatgggt

SEQ ID NO: 43185 - DNA, 15 bp, Homo sapiens
gagtggtaatgggtg

SEQ ID NO: 43186 - DNA, 15 bp, Homo sapiens
agtggtaatgggtgg

SEQ ID NO: 43187 - DNA, 15 bp, Homo sapiens
gtggtaatgggtggg

SEQ ID NO: 43188 - DNA, 15 bp, Homo sapiens
tggtaatgggtgggc

SEQ ID NO: 43189 - DNA, 15 bp, Homo sapiens
ggtaatgggtgggca

SEQ ID NO: 43190 - DNA, 15 bp, Homo sapiens
gtaatgggtgggcat

SEQ ID NO: 43191 - DNA, 15 bp, Homo sapiens
taatgggtgggcatg

SEQ ID NO: 43192 - DNA, 15 bp, Homo sapiens
aatgggtgggcatga

SEQ ID NO: 43193 - DNA, 15 bp, Homo sapiens
atgggtgggcatgaa

SEQ ID NO: 43194 - DNA, 15 bp, Homo sapiens
tgggtgggcatgaat

SEQ ID NO: 43195 - DNA, 15 bp, Homo sapiens
gggtgggcatgaatg

SEQ ID NO: 43196 - DNA, 15 bp, Homo sapiens
ggtgggcatgaatga

SEQ ID NO: 43197 - DNA, 15 bp, Homo sapiens
gtgggcatgaatgag

SEQ ID NO: 43198 - DNA, 15 bp, Homo sapiens
tgggcatgaatgaga

SEQ ID NO: 43199 - DNA, 15 bp, Homo sapiens
gggcatgaatgagag

SEQ ID NO: 43200 - DNA, 15 bp, Homo sapiens
ggcatgaatgagagg

SEQ ID NO: 43201 - DNA, 15 bp, Homo sapiens
gcatgaatgagaggt

SEQ ID NO: 43202 - DNA, 15 bp, Homo sapiens
catgaatgagaggtt

SEQ ID NO: 43203 - DNA, 15 bp, Homo sapiens
atgaatgagaggttc

SEQ ID NO: 43204 - DNA, 15 bp, Homo sapiens
tgaatgagaggttct

SEQ ID NO: 43205 - DNA, 15 bp, Homo sapiens
gaatgagaggttcta

SEQ ID NO: 43206 - DNA, 15 bp, Homo sapiens
aatgagaggttctag

SEQ ID NO: 43207 - DNA, 15 bp, Homo sapiens
atgagaggttctagg

SEQ ID NO: 43208 - DNA, 15 bp, Homo sapiens
tgagaggttctaggt

SEQ ID NO: 43209 - DNA, 15 bp, Homo sapiens
gagaggttctaggtt

SEQ ID NO: 43210 - DNA, 15 bp, Homo sapiens
agaggttctaggttc

SEQ ID NO: 43211 - DNA, 15 bp, Homo sapiens
gaggttctaggttct

SEQ ID NO: 43212 - DNA, 15 bp, Homo sapiens
aggttctaggttctt

SEQ ID NO: 43213 - DNA, 15 bp, Homo sapiens
ggttctaggttcttg

SEQ ID NO: 43214 - DNA, 15 bp, Homo sapiens
gttctaggttcttgg

SEQ ID NO: 43215 - DNA, 15 bp, Homo sapiens
ttctaggttcttggt

SEQ ID NO: 43216 - DNA, 15 bp, Homo sapiens
tctaggttcttggtg

SEQ ID NO: 43217 - DNA, 15 bp, Homo sapiens
ctaggttcttggtgt

SEQ ID NO: 43218 - DNA, 15 bp, Homo sapiens
taggttcttggtgtg

SEQ ID NO: 43219 - DNA, 15 bp, Homo sapiens
aggttcttggtgtgg

SEQ ID NO: 43220 - DNA, 15 bp, Homo sapiens
ggttcttggtgtggg

SEQ ID NO: 43221 - DNA, 15 bp, Homo sapiens
gttcttggtgtgggt

SEQ ID NO: 43222 - DNA, 15 bp, Homo sapiens
ttcttggtgtgggtc

SEQ ID NO: 43223 - DNA, 15 bp, Homo sapiens
tcttggtgtgggtcg

SEQ ID NO: 43224 - DNA, 15 bp, Homo sapiens
cttggtgtgggtcgc

SEQ ID NO: 43225 - DNA, 15 bp, Homo sapiens
ttggtgtgggtcgca

SEQ ID NO: 43226 - DNA, 15 bp, Homo sapiens
tggtgtgggtcgcag

SEQ ID NO: 43227 - DNA, 15 bp, Homo sapiens
ggtgtgggtcgcaga

SEQ ID NO: 43228 - DNA, 15 bp, Homo sapiens
gtgtgggtcgcagag

SEQ ID NO: 43229 - DNA, 15 bp, Homo sapiens
tgtgggtcgcagaga

SEQ ID NO: 43230 - DNA, 15 bp, Homo sapiens
gtgggtcgcagagat

SEQ ID NO: 43231 - DNA, 15 bp, Homo sapiens
tgggtcgcagagatc

SEQ ID NO: 43232 - DNA, 15 bp, Homo sapiens
gggtcgcagagatct

SEQ ID NO: 43233 - DNA, 15 bp, Homo sapiens
ggtcgcagagatctg

SEQ ID NO: 43234 - DNA, 15 bp, Homo sapiens
gtcgcagagatctgt

SEQ ID NO: 43235 - DNA, 15 bp, Homo sapiens
tcgcagagatctgtt

SEQ ID NO: 43236 - DNA, 15 bp, Homo sapiens
cgcagagatctgttt

SEQ ID NO: 43237 - DNA, 15 bp, Homo sapiens
gcagagatctgtttt

SEQ ID NO: 43238 - DNA, 15 bp, Homo sapiens
cagagatctgttttt

SEQ ID NO: 43239 - DNA, 15 bp, Homo sapiens
agagatctgtttttt

SEQ ID NO: 43240 - DNA, 15 bp, Homo sapiens
gagatctgttttttc

SEQ ID NO: 43241 - DNA, 15 bp, Homo sapiens
agatctgttttttct

SEQ ID NO: 43242 - DNA, 15 bp, Homo sapiens
gatctgttttttctg

SEQ ID NO: 43243 - DNA, 15 bp, Homo sapiens
atctgttttttctgt

SEQ ID NO: 43244 - DNA, 15 bp, Homo sapiens
tctgttttttctgtc

SEQ ID NO: 43245 - DNA, 15 bp, Homo sapiens
ctgttttttctgtct

SEQ ID NO: 43246 - DNA, 15 bp, Homo sapiens
tgttttttctgtctc

SEQ ID NO: 43247 - DNA, 15 bp, Homo sapiens
gttttttctgtctca

SEQ ID NO: 43248 - DNA, 15 bp, Homo sapiens
ttttttctgtctcac

SEQ ID NO: 43249 - DNA, 15 bp, Homo sapiens
tttttctgtctcaca

SEQ ID NO: 43250 - DNA, 15 bp, Homo sapiens
ttttctgtctcacaa

SEQ ID NO: 43251 - DNA, 15 bp, Homo sapiens
tttctgtctcacaac

SEQ ID NO: 43252 - DNA, 15 bp, Homo sapiens
ttctgtctcacaacc

SEQ ID NO: 43253 - DNA, 15 bp, Homo sapiens
tctgtctcacaaccc

SEQ ID NO: 43254 - DNA, 15 bp, Homo sapiens
ctgtctcacaacccg

SEQ ID NO: 43255 - DNA, 15 bp, Homo sapiens
tgtctcacaacccgc

SEQ ID NO: 43256 - DNA, 15 bp, Homo sapiens
gtctcacaacccgct

SEQ ID NO: 43257 - DNA, 15 bp, Homo sapiens
tctcacaacccgctt

SEQ ID NO: 43258 - DNA, 15 bp, Homo sapiens
ctcacaacccgctta

SEQ ID NO: 43259 - DNA, 15 bp, Homo sapiens
tcacaacccgcttag

SEQ ID NO: 43260 - DNA, 15 bp, Homo sapiens
cacaacccgcttagg

SEQ ID NO: 43261 - DNA, 15 bp, Homo sapiens
acaacccgcttaggt

SEQ ID NO: 43262 - DNA, 15 bp, Homo sapiens
caacccgcttaggtg

SEQ ID NO: 43263 - DNA, 15 bp, Homo sapiens
aacccgcttaggtga

SEQ ID NO: 43264 - DNA, 15 bp, Homo sapiens
acccgcttaggtgaa

SEQ ID NO: 43265 - DNA, 15 bp, Homo sapiens
cccgcttaggtgaat

SEQ ID NO: 43266 - DNA, 15 bp, Homo sapiens
ccgcttaggtgaatc

SEQ ID NO: 43267 - DNA, 15 bp, Homo sapiens
cgcttaggtgaatct

SEQ ID NO: 43268 - DNA, 15 bp, Homo sapiens
gcttaggtgaatctg

SEQ ID NO: 43269 - DNA, 15 bp, Homo sapiens
cttaggtgaatctgt

SEQ ID NO: 43270 - DNA, 15 bp, Homo sapiens
ttaggtgaatctgtc

SEQ ID NO: 43271 - DNA, 15 bp, Homo sapiens
taggtgaatctgtct

SEQ ID NO: 43272 - DNA, 15 bp, Homo sapiens
aggtgaatctgtctc

SEQ ID NO: 43273 - DNA, 15 bp, Homo sapiens
ggtgaatctgtctct

SEQ ID NO: 43274 - DNA, 15 bp, Homo sapiens
gtgaatctgtctctg

SEQ ID NO: 43275 - DNA, 15 bp, Homo sapiens
tgaatctgtctctgt

SEQ ID NO: 43276 - DNA, 15 bp, Homo sapiens
gaatctgtctctgtc

SEQ ID NO: 43277 - DNA, 15 bp, Homo sapiens
aatctgtctctgtca

SEQ ID NO: 43278 - DNA, 15 bp, Homo sapiens
atctgtctctgtcat

SEQ ID NO: 43279 - DNA, 15 bp, Homo sapiens
tctgtctctgtcatc

SEQ ID NO: 43280 - DNA, 15 bp, Homo sapiens
ctgtctctgtcatca

SEQ ID NO: 43281 - DNA, 15 bp, Homo sapiens
tgtctctgtcatcaa

SEQ ID NO: 43282 - DNA, 15 bp, Homo sapiens
gtctctgtcatcaag

SEQ ID NO: 43283 - DNA, 15 bp, Homo sapiens
tctctgtcatcaagc

SEQ ID NO: 43284 - DNA, 15 bp, Homo sapiens
ctctgtcatcaagca

SEQ ID NO: 43285 - DNA, 15 bp, Homo sapiens
tctgtcatcaagcac

SEQ ID NO: 43286 - DNA, 15 bp, Homo sapiens
ctgtcatcaagcaca

SEQ ID NO: 43287 - DNA, 15 bp, Homo sapiens
tgtcatcaagcacac

SEQ ID NO: 43288 - DNA, 15 bp, Homo sapiens
gtcatcaagcacact

SEQ ID NO: 43289 - DNA, 15 bp, Homo sapiens
tcatcaagcacactg

SEQ ID NO: 43290 - DNA, 15 bp, Homo sapiens
catcaagcacactga

SEQ ID NO: 43291 - DNA, 15 bp, Homo sapiens
atcaagcacactgat

SEQ ID NO: 43292 - DNA, 15 bp, Homo sapiens
tcaagcacactgatc

SEQ ID NO: 43293 - DNA, 15 bp, Homo sapiens
caagcacactgatcc

SEQ ID NO: 43294 - DNA, 15 bp, Homo sapiens
aagcacactgatccc

SEQ ID NO: 43295 - DNA, 15 bp, Homo sapiens
agcacactgatcccg

SEQ ID NO: 43296 - DNA, 15 bp, Homo sapiens
gcacactgatcccgt

SEQ ID NO: 43297 - DNA, 15 bp, Homo sapiens
cacactgatcccgtc

SEQ ID NO: 43298 - DNA, 15 bp, Homo sapiens
acactgatcccgtcc

SEQ ID NO: 43299 - DNA, 15 bp, Homo sapiens
cactgatcccgtccc

SEQ ID NO: 43300 - DNA, 15 bp, Homo sapiens
actgatcccgtccct

SEQ ID NO: 43301 - DNA, 15 bp, Homo sapiens
ctgatcccgtccctg

SEQ ID NO: 43302 - DNA, 15 bp, Homo sapiens
tgatcccgtccctga

SEQ ID NO: 43303 - DNA, 15 bp, Homo sapiens
gatcccgtccctgac

SEQ ID NO: 43304 - DNA, 15 bp, Homo sapiens
atcccgtccctgacc

SEQ ID NO: 43305 - DNA, 15 bp, Homo sapiens
tcccgtccctgaccc

SEQ ID NO: 43306 - DNA, 15 bp, Homo sapiens
cccgtccctgaccca

SEQ ID NO: 43307 - DNA, 15 bp, Homo sapiens
ccgtccctgacccac

SEQ ID NO: 43308 - DNA, 15 bp, Homo sapiens
cgtccctgacccacg

SEQ ID NO: 43309 - DNA, 15 bp, Homo sapiens
gtccctgacccacga

SEQ ID NO: 43310 - DNA, 15 bp, Homo sapiens
tccctgacccacgag

SEQ ID NO: 43311 - DNA, 15 bp, Homo sapiens
ccctgacccacgagc

SEQ ID NO: 43312 - DNA, 15 bp, Homo sapiens
cctgacccacgagct

SEQ ID NO: 43313 - DNA, 15 bp, Homo sapiens
ctgacccacgagctg

SEQ ID NO: 43314 - DNA, 15 bp, Homo sapiens
tgacccacgagctgt

SEQ ID NO: 43315 - DNA, 15 bp, Homo sapiens
gacccacgagctgtc

SEQ ID NO: 43316 - DNA, 15 bp, Homo sapiens
acccacgagctgtca

SEQ ID NO: 43317 - DNA, 15 bp, Homo sapiens
cccacgagctgtcaa

SEQ ID NO: 43318 - DNA, 15 bp, Homo sapiens
ccacgagctgtcaac

SEQ ID NO: 43319 - DNA, 15 bp, Homo sapiens
cacgagctgtcaacc

SEQ ID NO: 43320 - DNA, 15 bp, Homo sapiens
acgagctgtcaacca

SEQ ID NO: 43321 - DNA, 15 bp, Homo sapiens
cgagctgtcaaccaa

SEQ ID NO: 43322 - DNA, 15 bp, Homo sapiens
gagctgtcaaccaag

SEQ ID NO: 43323 - DNA, 15 bp, Homo sapiens
agctgtcaaccaaga

SEQ ID NO: 43324 - DNA, 15 bp, Homo sapiens
gctgtcaaccaagat

SEQ ID NO: 43325 - DNA, 15 bp, Homo sapiens
ctgtcaaccaagata

SEQ ID NO: 43326 - DNA, 15 bp, Homo sapiens
tgtcaaccaagataa

SEQ ID NO: 43327 - DNA, 15 bp, Homo sapiens
gtcaaccaagataaa

SEQ ID NO: 43328 - DNA, 15 bp, Homo sapiens
tcaaccaagataaaa

SEQ ID NO: 43329 - DNA, 15 bp, Homo sapiens
caaccaagataaaaa

SEQ ID NO: 43330 - DNA, 15 bp, Homo sapiens
aaccaagataaaaag

SEQ ID NO: 43331 - DNA, 15 bp, Homo sapiens
accaagataaaaaga

SEQ ID NO: 43332 - DNA, 15 bp, Homo sapiens
ccaagataaaaagaa

SEQ ID NO: 43333 - DNA, 15 bp, Homo sapiens
caagataaaaagaac

SEQ ID NO: 43334 - DNA, 15 bp, Homo sapiens
aagataaaaagaaca

SEQ ID NO: 43335 - DNA, 15 bp, Homo sapiens
agataaaaagaacat

SEQ ID NO: 43336 - DNA, 15 bp, Homo sapiens
gataaaaagaacatg

SEQ ID NO: 43337 - DNA, 15 bp, Homo sapiens
ataaaaagaacatgc

SEQ ID NO: 43338 - DNA, 15 bp, Homo sapiens
taaaaagaacatgct

SEQ ID NO: 43339 - DNA, 15 bp, Homo sapiens
aaaaagaacatgctg

SEQ ID NO: 43340 - DNA, 15 bp, Homo sapiens
aaaagaacatgctgt

SEQ ID NO: 43341 - DNA, 15 bp, Homo sapiens
aaagaacatgctgtt

SEQ ID NO: 43342 - DNA, 15 bp, Homo sapiens
aagaacatgctgttt

SEQ ID NO: 43343 - DNA, 15 bp, Homo sapiens
agaacatgctgtttt

SEQ ID NO: 43344 - DNA, 15 bp, Homo sapiens
gaacatgctgttttc

SEQ ID NO: 43345 - DNA, 15 bp, Homo sapiens
aacatgctgttttct

SEQ ID NO: 43346 - DNA, 15 bp, Homo sapiens
acatgctgttttctg

SEQ ID NO: 43347 - DNA, 15 bp, Homo sapiens
catgctgttttctgt

SEQ ID NO: 43348 - DNA, 15 bp, Homo sapiens
atgctgttttctgta

SEQ ID NO: 43349 - DNA, 15 bp, Homo sapiens
tgctgttttctgtaa

SEQ ID NO: 43350 - DNA, 15 bp, Homo sapiens
gctgttttctgtaag

SEQ ID NO: 43351 - DNA, 15 bp, Homo sapiens
ctgttttctgtaagt

SEQ ID NO: 43352 - DNA, 15 bp, Homo sapiens
tgttttctgtaagta

SEQ ID NO: 43353 - DNA, 15 bp, Homo sapiens
gttttctgtaagtac

SEQ ID NO: 43354 - DNA, 15 bp, Homo sapiens
ttttctgtaagtact

SEQ ID NO: 43355 - DNA, 15 bp, Homo sapiens
tttctgtaagtactt

SEQ ID NO: 43356 - DNA, 15 bp, Homo sapiens
ttctgtaagtacttt

SEQ ID NO: 43357 - DNA, 15 bp, Homo sapiens
tctgtaagtacttta

SEQ ID NO: 43358 - DNA, 15 bp, Homo sapiens
ctgtaagtactttat

SEQ ID NO: 43359 - DNA, 15 bp, Homo sapiens
tgtaagtactttatg

SEQ ID NO: 43360 - DNA, 15 bp, Homo sapiens
gtaagtactttatga

SEQ ID NO: 43361 - DNA, 15 bp, Homo sapiens
taagtactttatgaa

SEQ ID NO: 43362 - DNA, 15 bp, Homo sapiens
aagtactttatgaaa

SEQ ID NO: 43363 - DNA, 15 bp, Homo sapiens
agtactttatgaaat

SEQ ID NO: 43364 - DNA, 15 bp, Homo sapiens
gtactttatgaaatg

SEQ ID NO: 43365 - DNA, 15 bp, Homo sapiens
tactttatgaaatgt

SEQ ID NO: 43366 - DNA, 15 bp, Homo sapiens
actttatgaaatgtg

SEQ ID NO: 43367 - DNA, 15 bp, Homo sapiens
ctttatgaaatgtgt

SEQ ID NO: 43368 - DNA, 15 bp, Homo sapiens
tttatgaaatgtgtt

SEQ ID NO: 43369 - DNA, 15 bp, Homo sapiens
ttatgaaatgtgttt

SEQ ID NO: 43370 - DNA, 15 bp, Homo sapiens
tatgaaatgtgtttt

SEQ ID NO: 43371 - DNA, 15 bp, Homo sapiens
atgaaatgtgttttt

SEQ ID NO: 43372 - DNA, 15 bp, Homo sapiens
tgaaatgtgttttta

SEQ ID NO: 43373 - DNA, 15 bp, Homo sapiens
gaaatgtgtttttat

SEQ ID NO: 43374 - DNA, 15 bp, Homo sapiens
aaatgtgtttttatt

SEQ ID NO: 43375 - DNA, 15 bp, Homo sapiens
aatgtgtttttattt

SEQ ID NO: 43376 - DNA, 15 bp, Homo sapiens
atgtgtttttattta

SEQ ID NO: 43377 - DNA, 15 bp, Homo sapiens
tgtgtttttatttac

SEQ ID NO: 43378 - DNA, 15 bp, Homo sapiens
gtgtttttatttaca

SEQ ID NO: 43379 - DNA, 15 bp, Homo sapiens
tgtttttatttacag

SEQ ID NO: 43380 - DNA, 15 bp, Homo sapiens
gtttttatttacaga

SEQ ID NO: 43381 - DNA, 15 bp, Homo sapiens
tttttatttacagac

SEQ ID NO: 43382 - DNA, 15 bp, Homo sapiens
ttttatttacagaca

SEQ ID NO: 43383 - DNA, 15 bp, Homo sapiens
tttatttacagacat

SEQ ID NO: 43384 - DNA, 15 bp, Homo sapiens
ttatttacagacatt

SEQ ID NO: 43385 - DNA, 15 bp, Homo sapiens
tatttacagacattt

SEQ ID NO: 43386 - DNA, 15 bp, Homo sapiens
atttacagacatttc

SEQ ID NO: 43387 - DNA, 15 bp, Homo sapiens
tttacagacatttcc

SEQ ID NO: 43388 - DNA, 15 bp, Homo sapiens
ttacagacatttcca

SEQ ID NO: 43389 - DNA, 15 bp, Homo sapiens
tacagacatttccaa

SEQ ID NO: 43390 - DNA, 15 bp, Homo sapiens
acagacatttccaaa

SEQ ID NO: 43391 - DNA, 15 bp, Homo sapiens
cagacatttccaaag

SEQ ID NO: 43392 - DNA, 15 bp, Homo sapiens
agacatttccaaagc

SEQ ID NO: 43393 - DNA, 15 bp, Homo sapiens
gacatttccaaagcc

SEQ ID NO: 43394 - DNA, 15 bp, Homo sapiens
acatttccaaagcct

SEQ ID NO: 43395 - DNA, 15 bp, Homo sapiens
catttccaaagccta

SEQ ID NO: 43396 - DNA, 15 bp, Homo sapiens
atttccaaagcctaa

SEQ ID NO: 43397 - DNA, 15 bp, Homo sapiens
tttccaaagcctaat

SEQ ID NO: 43398 - DNA, 15 bp, Homo sapiens
ttccaaagcctaatc

SEQ ID NO: 43399 - DNA, 15 bp, Homo sapiens
tccaaagcctaatca

SEQ ID NO: 43400 - DNA, 15 bp, Homo sapiens
ccaaagcctaatcaa

SEQ ID NO: 43401 - DNA, 15 bp, Homo sapiens
caaagcctaatcaaa

SEQ ID NO: 43402 - DNA, 15 bp, Homo sapiens
aaagcctaatcaaat

SEQ ID NO: 43403 - DNA, 15 bp, Homo sapiens
aagcctaatcaaatg

SEQ ID NO: 43404 - DNA, 15 bp, Homo sapiens
agcctaatcaaatgt

SEQ ID NO: 43405 - DNA, 15 bp, Homo sapiens
gcctaatcaaatgtt

SEQ ID NO: 43406 - DNA, 15 bp, Homo sapiens
cctaatcaaatgtta

SEQ ID NO: 43407 - DNA, 15 bp, Homo sapiens
ctaatcaaatgttat

SEQ ID NO: 43408 - DNA, 15 bp, Homo sapiens
taatcaaatgttatg

SEQ ID NO: 43409 - DNA, 15 bp, Homo sapiens
aatcaaatgttatgt

SEQ ID NO: 43410 - DNA, 15 bp, Homo sapiens
atcaaatgttatgtt

SEQ ID NO: 43411 - DNA, 15 bp, Homo sapiens
tcaaatgttatgttt

SEQ ID NO: 43412 - DNA, 15 bp, Homo sapiens
caaatgttatgtttt

SEQ ID NO: 43413 - DNA, 15 bp, Homo sapiens
aaatgttatgttttt

SEQ ID NO: 43414 - DNA, 15 bp, Homo sapiens
aatgttatgtttttc

SEQ ID NO: 43415 - DNA, 15 bp, Homo sapiens
atgttatgtttttca

SEQ ID NO: 43416 - DNA, 15 bp, Homo sapiens
tgttatgtttttcac

SEQ ID NO: 43417 - DNA, 15 bp, Homo sapiens
gttatgtttttcact

SEQ ID NO: 43418 - DNA, 15 bp, Homo sapiens
ttatgtttttcactg

SEQ ID NO: 43419 - DNA, 15 bp, Homo sapiens
tatgtttttcactgc

SEQ ID NO: 43420 - DNA, 15 bp, Homo sapiens
atgtttttcactgcc

SEQ ID NO: 43421 - DNA, 15 bp, Homo sapiens
tgtttttcactgcca

SEQ ID NO: 43422 - DNA, 15 bp, Homo sapiens
gtttttcactgccaa

SEQ ID NO: 43423 - DNA, 15 bp, Homo sapiens
tttttcactgccaac

SEQ ID NO: 43424 - DNA, 15 bp, Homo sapiens
ttttcactgccaacc

SEQ ID NO: 43425 - DNA, 15 bp, Homo sapiens
tttcactgccaacca

SEQ ID NO: 43426 - DNA, 15 bp, Homo sapiens
ttcactgccaaccat

SEQ ID NO: 43427 - DNA, 15 bp, Homo sapiens
tcactgccaaccatc

SEQ ID NO: 43428 - DNA, 15 bp, Homo sapiens
cactgccaaccatca

SEQ ID NO: 43429 - DNA, 15 bp, Homo sapiens
actgccaaccatcac

SEQ ID NO: 43430 - DNA, 15 bp, Homo sapiens
ctgccaaccatcact

SEQ ID NO: 43431 - DNA, 15 bp, Homo sapiens
tgccaaccatcactg

SEQ ID NO: 43432 - DNA, 15 bp, Homo sapiens
gccaaccatcactgg

SEQ ID NO: 43433 - DNA, 15 bp, Homo sapiens
ccaaccatcactggc

SEQ ID NO: 43434 - DNA, 15 bp, Homo sapiens
caaccatcactggct

SEQ ID NO: 43435 - DNA, 15 bp, Homo sapiens
aaccatcactggcta

SEQ ID NO: 43436 - DNA, 15 bp, Homo sapiens
accatcactggctat

SEQ ID NO: 43437 - DNA, 15 bp, Homo sapiens
ccatcactggctatc

SEQ ID NO: 43438 - DNA, 15 bp, Homo sapiens
catcactggctatca

SEQ ID NO: 43439 - DNA, 15 bp, Homo sapiens
atcactggctatcat

SEQ ID NO: 43440 - DNA, 15 bp, Homo sapiens
tcactggctatcatt

SEQ ID NO: 43441 - DNA, 15 bp, Homo sapiens
cactggctatcattc

SEQ ID NO: 43442 - DNA, 15 bp, Homo sapiens
actggctatcattct

SEQ ID NO: 43443 - DNA, 15 bp, Homo sapiens
ctggctatcattcta

SEQ ID NO: 43444 - DNA, 15 bp, Homo sapiens
tggctatcattctaa

SEQ ID NO: 43445 - DNA, 15 bp, Homo sapiens
ggctatcattctaaa

SEQ ID NO: 43446 - DNA, 15 bp, Homo sapiens
gctatcattctaaag

SEQ ID NO: 43447 - DNA, 15 bp, Homo sapiens
ctatcattctaaagg

SEQ ID NO: 43448 - DNA, 15 bp, Homo sapiens
tatcattctaaagga

SEQ ID NO: 43449 - DNA, 15 bp, Homo sapiens
atcattctaaaggat

SEQ ID NO: 43450 - DNA, 15 bp, Homo sapiens
tcattctaaaggata

SEQ ID NO: 43451 - DNA, 15 bp, Homo sapiens
cattctaaaggataa

SEQ ID NO: 43452 - DNA, 15 bp, Homo sapiens
attctaaaggataat

SEQ ID NO: 43453 - DNA, 15 bp, Homo sapiens
ttctaaaggataatc

SEQ ID NO: 43454 - DNA, 15 bp, Homo sapiens
tctaaaggataatca

SEQ ID NO: 43455 - DNA, 15 bp, Homo sapiens
ctaaaggataatcac

SEQ ID NO: 43456 - DNA, 15 bp, Homo sapiens
taaaggataatcaca

SEQ ID NO: 43457 - DNA, 15 bp, Homo sapiens
aaaggataatcacac

SEQ ID NO: 43458 - DNA, 15 bp, Homo sapiens
aaggataatcacact

SEQ ID NO: 43459 - DNA, 15 bp, Homo sapiens
aggataatcacactt

SEQ ID NO: 43460 - DNA, 15 bp, Homo sapiens
ggataatcacacttt

SEQ ID NO: 43461 - DNA, 15 bp, Homo sapiens
gataatcacactttt

SEQ ID NO: 43462 - DNA, 15 bp, Homo sapiens
ataatcacacttttc

SEQ ID NO: 43463 - DNA, 15 bp, Homo sapiens
taatcacacttttca

SEQ ID NO: 43464 - DNA, 15 bp, Homo sapiens
aatcacacttttcat

SEQ ID NO: 43465 - DNA, 15 bp, Homo sapiens
atcacacttttcatg

SEQ ID NO: 43466 - DNA, 15 bp, Homo sapiens
tcacacttttcatgg

SEQ ID NO: 43467 - DNA, 15 bp, Homo sapiens
cacacttttcatggt

SEQ ID NO: 43468 - DNA, 15 bp, Homo sapiens
acacttttcatggtc

SEQ ID NO: 43469 - DNA, 15 bp, Homo sapiens
cacttttcatggtca

SEQ ID NO: 43470 - DNA, 15 bp, Homo sapiens
acttttcatggtcag

SEQ ID NO: 43471 - DNA, 15 bp, Homo sapiens
cttttcatggtcagt

SEQ ID NO: 43472 - DNA, 15 bp, Homo sapiens
ttttcatggtcagtc

SEQ ID NO: 43473 - DNA, 15 bp, Homo sapiens
tttcatggtcagtct

SEQ ID NO: 43474 - DNA, 15 bp, Homo sapiens
ttcatggtcagtctt

SEQ ID NO: 43475 - DNA, 15 bp, Homo sapiens
tcatggtcagtctta

SEQ ID NO: 43476 - DNA, 15 bp, Homo sapiens
catggtcagtcttag

SEQ ID NO: 43477 - DNA, 15 bp, Homo sapiens
atggtcagtcttagg

SEQ ID NO: 43478 - DNA, 15 bp, Homo sapiens
tggtcagtcttaggt

SEQ ID NO: 43479 - DNA, 15 bp, Homo sapiens
ggtcagtcttaggtg

SEQ ID NO: 43480 - DNA, 15 bp, Homo sapiens
gtcagtcttaggtgt

SEQ ID NO: 43481 - DNA, 15 bp, Homo sapiens
tcagtcttaggtgtc

SEQ ID NO: 43482 - DNA, 15 bp, Homo sapiens
cagtcttaggtgtca

SEQ ID NO: 43483 - DNA, 15 bp, Homo sapiens
agtcttaggtgtcag

SEQ ID NO: 43484 - DNA, 15 bp, Homo sapiens
gtcttaggtgtcaga

SEQ ID NO: 43485 - DNA, 15 bp, Homo sapiens
tcttaggtgtcagaa

SEQ ID NO: 43486 - DNA, 15 bp, Homo sapiens
cttaggtgtcagaat

SEQ ID NO: 43487 - DNA, 15 bp, Homo sapiens
ttaggtgtcagaata

SEQ ID NO: 43488 - DNA, 15 bp, Homo sapiens
taggtgtcagaatat

SEQ ID NO: 43489 - DNA, 15 bp, Homo sapiens
aggtgtcagaatatg

SEQ ID NO: 43490 - DNA, 15 bp, Homo sapiens
ggtgtcagaatatgg

SEQ ID NO: 43491 - DNA, 15 bp, Homo sapiens
gtgtcagaatatggc

SEQ ID NO: 43492 - DNA, 15 bp, Homo sapiens
tgtcagaatatggca

SEQ ID NO: 43493 - DNA, 15 bp, Homo sapiens
gtcagaatatggcag

SEQ ID NO: 43494 - DNA, 15 bp, Homo sapiens
tcagaatatggcagt

SEQ ID NO: 43495 - DNA, 15 bp, Homo sapiens
cagaatatggcagta

SEQ ID NO: 43496 - DNA, 15 bp, Homo sapiens
agaatatggcagtaa

SEQ ID NO: 43497 - DNA, 15 bp, Homo sapiens
gaatatggcagtaac

SEQ ID NO: 43498 - DNA, 15 bp, Homo sapiens
aatatggcagtaaca

SEQ ID NO: 43499 - DNA, 15 bp, Homo sapiens
atatggcagtaacat

SEQ ID NO: 43500 - DNA, 15 bp, Homo sapiens
tatggcagtaacata

SEQ ID NO: 43501 - DNA, 15 bp, Homo sapiens
atggcagtaacataa

SEQ ID NO: 43502 - DNA, 15 bp, Homo sapiens
tggcagtaacataac

SEQ ID NO: 43503 - DNA, 15 bp, Homo sapiens
ggcagtaacataacg

SEQ ID NO: 43504 - DNA, 15 bp, Homo sapiens
gcagtaacataacgt

SEQ ID NO: 43505 - DNA, 15 bp, Homo sapiens
cagtaacataacgtg

SEQ ID NO: 43506 - DNA, 15 bp, Homo sapiens
agtaacataacgtgt

SEQ ID NO: 43507 - DNA, 15 bp, Homo sapiens
gtaacataacgtgtg

SEQ ID NO: 43508 - DNA, 15 bp, Homo sapiens
taacataacgtgtga

SEQ ID NO: 43509 - DNA, 15 bp, Homo sapiens
aacataacgtgtgac

SEQ ID NO: 43510 - DNA, 15 bp, Homo sapiens
acataacgtgtgact

SEQ ID NO: 43511 - DNA, 15 bp, Homo sapiens
cataacgtgtgactt

SEQ ID NO: 43512 - DNA, 15 bp, Homo sapiens
ataacgtgtgactta

SEQ ID NO: 43513 - DNA, 15 bp, Homo sapiens
taacgtgtgacttag

SEQ ID NO: 43514 - DNA, 15 bp, Homo sapiens
aacgtgtgacttaga

SEQ ID NO: 43515 - DNA, 15 bp, Homo sapiens
acgtgtgacttagat

SEQ ID NO: 43516 - DNA, 15 bp, Homo sapiens
cgtgtgacttagatg

SEQ ID NO: 43517 - DNA, 15 bp, Homo sapiens
gtgtgacttagatgt

SEQ ID NO: 43518 - DNA, 15 bp, Homo sapiens
tgtgacttagatgtc

SEQ ID NO: 43519 - DNA, 15 bp, Homo sapiens
gtgacttagatgtct

SEQ ID NO: 43520 - DNA, 15 bp, Homo sapiens
tgacttagatgtctt

SEQ ID NO: 43521 - DNA, 15 bp, Homo sapiens
gacttagatgtcttt

SEQ ID NO: 43522 - DNA, 15 bp, Homo sapiens
acttagatgtctttt

SEQ ID NO: 43523 - DNA, 15 bp, Homo sapiens
cttagatgtctttta

SEQ ID NO: 43524 - DNA, 15 bp, Homo sapiens
ttagatgtcttttaa

SEQ ID NO: 43525 - DNA, 15 bp, Homo sapiens
tagatgtcttttaat

SEQ ID NO: 43526 - DNA, 15 bp, Homo sapiens
agatgtcttttaatt

SEQ ID NO: 43527 - DNA, 15 bp, Homo sapiens
gatgtcttttaattg

SEQ ID NO: 43528 - DNA, 15 bp, Homo sapiens
atgtcttttaattgg

SEQ ID NO: 43529 - DNA, 15 bp, Homo sapiens
tgtcttttaattggc

SEQ ID NO: 43530 - DNA, 15 bp, Homo sapiens
gtcttttaattggca

SEQ ID NO: 43531 - DNA, 15 bp, Homo sapiens
tcttttaattggcaa

SEQ ID NO: 43532 - DNA, 15 bp, Homo sapiens
cttttaattggcaag

SEQ ID NO: 43533 - DNA, 15 bp, Homo sapiens
ttttaattggcaagt

SEQ ID NO: 43534 - DNA, 15 bp, Homo sapiens
tttaattggcaagtt

SEQ ID NO: 43535 - DNA, 15 bp, Homo sapiens
ttaattggcaagttt

SEQ ID NO: 43536 - DNA, 15 bp, Homo sapiens
taattggcaagtttt

SEQ ID NO: 43537 - DNA, 15 bp, Homo sapiens
aattggcaagttttg

SEQ ID NO: 43538 - DNA, 15 bp, Homo sapiens
attggcaagttttgg

SEQ ID NO: 43539 - DNA, 15 bp, Homo sapiens
ttggcaagttttggg

SEQ ID NO: 43540 - DNA, 15 bp, Homo sapiens
tggcaagttttgggg

SEQ ID NO: 43541 - DNA, 15 bp, Homo sapiens
ggcaagttttggggg

SEQ ID NO: 43542 - DNA, 15 bp, Homo sapiens
gcaagttttggggga

SEQ ID NO: 43543 - DNA, 15 bp, Homo sapiens
caagttttgggggac

SEQ ID NO: 43544 - DNA, 15 bp, Homo sapiens
aagttttgggggacc

SEQ ID NO: 43545 - DNA, 15 bp, Homo sapiens
agttttgggggacca

SEQ ID NO: 43546 - DNA, 15 bp, Homo sapiens
gttttgggggaccaa

SEQ ID NO: 43547 - DNA, 15 bp, Homo sapiens
ttttgggggaccaaa

SEQ ID NO: 43548 - DNA, 15 bp, Homo sapiens
tttgggggaccaaaa

SEQ ID NO: 43549 - DNA, 15 bp, Homo sapiens
ttgggggaccaaaaa

SEQ ID NO: 43550 - DNA, 15 bp, Homo sapiens
tgggggaccaaaaaa

SEQ ID NO: 43551 - DNA, 15 bp, Homo sapiens
gggggaccaaaaaat

SEQ ID NO: 43552 - DNA, 15 bp, Homo sapiens
ggggaccaaaaaata

SEQ ID NO: 43553 - DNA, 15 bp, Homo sapiens
gggaccaaaaaataa

SEQ ID NO: 43554 - DNA, 15 bp, Homo sapiens
ggaccaaaaaataat

SEQ ID NO: 43555 - DNA, 15 bp, Homo sapiens
gaccaaaaaataatg

SEQ ID NO: 43556 - DNA, 15 bp, Homo sapiens
accaaaaaataatga

SEQ ID NO: 43557 - DNA, 15 bp, Homo sapiens
ccaaaaaataatgac

SEQ ID NO: 43558 - DNA, 15 bp, Homo sapiens
caaaaaataatgact

SEQ ID NO: 43559 - DNA, 15 bp, Homo sapiens
aaaaaataatgacta

SEQ ID NO: 43560 - DNA, 15 bp, Homo sapiens
aaaaataatgactag

SEQ ID NO: 43561 - DNA, 15 bp, Homo sapiens
aaaataatgactagc

SEQ ID NO: 43562 - DNA, 15 bp, Homo sapiens
aaataatgactagct

SEQ ID NO: 43563 - DNA, 15 bp, Homo sapiens
aataatgactagctt

SEQ ID NO: 43564 - DNA, 15 bp, Homo sapiens
ataatgactagctta

SEQ ID NO: 43565 - DNA, 15 bp, Homo sapiens
taatgactagcttat

SEQ ID NO: 43566 - DNA, 15 bp, Homo sapiens
aatgactagcttata

SEQ ID NO: 43567 - DNA, 15 bp, Homo sapiens
atgactagcttatac

SEQ ID NO: 43568 - DNA, 15 bp, Homo sapiens
tgactagcttataca

SEQ ID NO: 43569 - DNA, 15 bp, Homo sapiens
gactagcttatacat

SEQ ID NO: 43570 - DNA, 15 bp, Homo sapiens
actagcttatacatc

SEQ ID NO: 43571 - DNA, 15 bp, Homo sapiens
ctagcttatacatct

SEQ ID NO: 43572 - DNA, 15 bp, Homo sapiens
tagcttatacatctt

SEQ ID NO: 43573 - DNA, 15 bp, Homo sapiens
agcttatacatcttc

SEQ ID NO: 43574 - DNA, 15 bp, Homo sapiens
gcttatacatcttca

SEQ ID NO: 43575 - DNA, 15 bp, Homo sapiens
cttatacatcttcaa

SEQ ID NO: 43576 - DNA, 15 bp, Homo sapiens
ttatacatcttcaaa

SEQ ID NO: 43577 - DNA, 15 bp, Homo sapiens
tatacatcttcaaac

SEQ ID NO: 43578 - DNA, 15 bp, Homo sapiens
atacatcttcaaact

SEQ ID NO: 43579 - DNA, 15 bp, Homo sapiens
tacatcttcaaactc

SEQ ID NO: 43580 - DNA, 15 bp, Homo sapiens
acatcttcaaactct

SEQ ID NO: 43581 - DNA, 15 bp, Homo sapiens
catcttcaaactctt

SEQ ID NO: 43582 - DNA, 15 bp, Homo sapiens
atcttcaaactctta

SEQ ID NO: 43583 - DNA, 15 bp, Homo sapiens
tcttcaaactcttac

SEQ ID NO: 43584 - DNA, 15 bp, Homo sapiens
cttcaaactcttacc

SEQ ID NO: 43585 - DNA, 15 bp, Homo sapiens
ttcaaactcttacct

SEQ ID NO: 43586 - DNA, 15 bp, Homo sapiens
tcaaactcttacctg

SEQ ID NO: 43587 - DNA, 15 bp, Homo sapiens
caaactcttacctgc

SEQ ID NO: 43588 - DNA, 15 bp, Homo sapiens
aaactcttacctgca

SEQ ID NO: 43589 - DNA, 15 bp, Homo sapiens
aactcttacctgcaa

SEQ ID NO: 43590 - DNA, 15 bp, Homo sapiens
actcttacctgcaaa

SEQ ID NO: 43591 - DNA, 15 bp, Homo sapiens
ctcttacctgcaaac

SEQ ID NO: 43592 - DNA, 15 bp, Homo sapiens
tcttacctgcaaaca

SEQ ID NO: 43593 - DNA, 15 bp, Homo sapiens
cttacctgcaaacat

SEQ ID NO: 43594 - DNA, 15 bp, Homo sapiens
ttacctgcaaacata

SEQ ID NO: 43595 - DNA, 15 bp, Homo sapiens
tacctgcaaacatag

SEQ ID NO: 43596 - DNA, 15 bp, Homo sapiens
acctgcaaacatagt

SEQ ID NO: 43597 - DNA, 15 bp, Homo sapiens
cctgcaaacatagtt

SEQ ID NO: 43598 - DNA, 15 bp, Homo sapiens
ctgcaaacatagttg

SEQ ID NO: 43599 - DNA, 15 bp, Homo sapiens
tgcaaacatagttga

SEQ ID NO: 43600 - DNA, 15 bp, Homo sapiens
gcaaacatagttgaa

SEQ ID NO: 43601 - DNA, 15 bp, Homo sapiens
caaacatagttgaaa

SEQ ID NO: 43602 - DNA, 15 bp, Homo sapiens
aaacatagttgaaaa

SEQ ID NO: 43603 - DNA, 15 bp, Homo sapiens
aacatagttgaaaag

SEQ ID NO: 43604 - DNA, 15 bp, Homo sapiens
acatagttgaaaagt

SEQ ID NO: 43605 - DNA, 15 bp, Homo sapiens
catagttgaaaagta

SEQ ID NO: 43606 - DNA, 15 bp, Homo sapiens
atagttgaaaagtag

SEQ ID NO: 43607 - DNA, 15 bp, Homo sapiens
tagttgaaaagtaga

SEQ ID NO: 43608 - DNA, 15 bp, Homo sapiens
agttgaaaagtagat

SEQ ID NO: 43609 - DNA, 15 bp, Homo sapiens
gttgaaaagtagatt

SEQ ID NO: 43610 - DNA, 15 bp, Homo sapiens
ttgaaaagtagattt

SEQ ID NO: 43611 - DNA, 15 bp, Homo sapiens
tgaaaagtagatttg

SEQ ID NO: 43612 - DNA, 15 bp, Homo sapiens
gaaaagtagatttgt

SEQ ID NO: 43613 - DNA, 15 bp, Homo sapiens
aaaagtagatttgtt

SEQ ID NO: 43614 - DNA, 15 bp, Homo sapiens
aaagtagatttgttt

SEQ ID NO: 43615 - DNA, 15 bp, Homo sapiens
aagtagatttgtttg

SEQ ID NO: 43616 - DNA, 15 bp, Homo sapiens
agtagatttgtttgg

SEQ ID NO: 43617 - DNA, 15 bp, Homo sapiens
gtagatttgtttgga

SEQ ID NO: 43618 - DNA, 15 bp, Homo sapiens
tagatttgtttggaa

SEQ ID NO: 43619 - DNA, 15 bp, Homo sapiens
agatttgtttggaaa

SEQ ID NO: 43620 - DNA, 15 bp, Homo sapiens
gatttgtttggaaaa

SEQ ID NO: 43621 - DNA, 15 bp, Homo sapiens
atttgtttggaaaag

SEQ ID NO: 43622 - DNA, 15 bp, Homo sapiens
tttgtttggaaaagc

SEQ ID NO: 43623 - DNA, 15 bp, Homo sapiens
ttgtttggaaaagcc

SEQ ID NO: 43624 - DNA, 15 bp, Homo sapiens
tgtttggaaaagcct

SEQ ID NO: 43625 - DNA, 15 bp, Homo sapiens
gtttggaaaagcctt

SEQ ID NO: 43626 - DNA, 15 bp, Homo sapiens
tttggaaaagcctta

SEQ ID NO: 43627 - DNA, 15 bp, Homo sapiens
ttggaaaagccttag

SEQ ID NO: 43628 - DNA, 15 bp, Homo sapiens
tggaaaagccttagc

SEQ ID NO: 43629 - DNA, 15 bp, Homo sapiens
ggaaaagccttagcc

SEQ ID NO: 43630 - DNA, 15 bp, Homo sapiens
gaaaagccttagcca

SEQ ID NO: 43631 - DNA, 15 bp, Homo sapiens
aaaagccttagccaa

SEQ ID NO: 43632 - DNA, 15 bp, Homo sapiens
aaagccttagccaat

SEQ ID NO: 43633 - DNA, 15 bp, Homo sapiens
aagccttagccaata

SEQ ID NO: 43634 - DNA, 15 bp, Homo sapiens
agccttagccaataa

SEQ ID NO: 43635 - DNA, 15 bp, Homo sapiens
gccttagccaataaa

SEQ ID NO: 43636 - DNA, 15 bp, Homo sapiens
ccttagccaataaag

SEQ ID NO: 43637 - DNA, 15 bp, Homo sapiens
cttagccaataaagg

SEQ ID NO: 43638 - DNA, 15 bp, Homo sapiens
ttagccaataaaggg

SEQ ID NO: 43639 - DNA, 15 bp, Homo sapiens
tagccaataaagggt

SEQ ID NO: 43640 - DNA, 15 bp, Homo sapiens
agccaataaagggta

SEQ ID NO: 43641 - DNA, 15 bp, Homo sapiens
gccaataaagggtat

SEQ ID NO: 43642 - DNA, 15 bp, Homo sapiens
ccaataaagggtatt

SEQ ID NO: 43643 - DNA, 15 bp, Homo sapiens
caataaagggtattt

SEQ ID NO: 43644 - DNA, 15 bp, Homo sapiens
aataaagggtatttt

SEQ ID NO: 43645 - DNA, 15 bp, Homo sapiens
ataaagggtattttc

SEQ ID NO: 43646 - DNA, 15 bp, Homo sapiens
taaagggtattttca

SEQ ID NO: 43647 - DNA, 15 bp, Homo sapiens
aaagggtattttcaa

SEQ ID NO: 43648 - DNA, 15 bp, Homo sapiens
aagggtattttcaaa

SEQ ID NO: 43649 - DNA, 15 bp, Homo sapiens
agggtattttcaaaa

SEQ ID NO: 43650 - DNA, 15 bp, Homo sapiens
gggtattttcaaaat

SEQ ID NO: 43651 - DNA, 15 bp, Homo sapiens
ggtattttcaaaatg

SEQ ID NO: 43652 - DNA, 15 bp, Homo sapiens
gtattttcaaaatga

SEQ ID NO: 43653 - DNA, 15 bp, Homo sapiens
tattttcaaaatgat

SEQ ID NO: 43654 - DNA, 15 bp, Homo sapiens
attttcaaaatgatg

SEQ ID NO: 43655 - DNA, 15 bp, Homo sapiens
ttttcaaaatgatgt

SEQ ID NO: 43656 - DNA, 15 bp, Homo sapiens
tttcaaaatgatgta

SEQ ID NO: 43657 - DNA, 15 bp, Homo sapiens
ttcaaaatgatgtag

SEQ ID NO: 43658 - DNA, 15 bp, Homo sapiens
tcaaaatgatgtaga

SEQ ID NO: 43659 - DNA, 15 bp, Homo sapiens
caaaatgatgtagat

SEQ ID NO: 43660 - DNA, 15 bp, Homo sapiens
aaaatgatgtagatg

SEQ ID NO: 43661 - DNA, 15 bp, Homo sapiens
aaatgatgtagatga

SEQ ID NO: 43662 - DNA, 15 bp, Homo sapiens
aatgatgtagatgac

SEQ ID NO: 43663 - DNA, 15 bp, Homo sapiens
atgatgtagatgaca

SEQ ID NO: 43664 - DNA, 15 bp, Homo sapiens
tgatgtagatgacag

SEQ ID NO: 43665 - DNA, 15 bp, Homo sapiens
gatgtagatgacagc

SEQ ID NO: 43666 - DNA, 15 bp, Homo sapiens
atgtagatgacagct

SEQ ID NO: 43667 - DNA, 15 bp, Homo sapiens
tgtagatgacagctg

SEQ ID NO: 43668 - DNA, 15 bp, Homo sapiens
gtagatgacagctgc

SEQ ID NO: 43669 - DNA, 15 bp, Homo sapiens
tagatgacagctgct

SEQ ID NO: 43670 - DNA, 15 bp, Homo sapiens
agatgacagctgcta

SEQ ID NO: 43671 - DNA, 15 bp, Homo sapiens
gatgacagctgctat

SEQ ID NO: 43672 - DNA, 15 bp, Homo sapiens
atgacagctgctatt

SEQ ID NO: 43673 - DNA, 15 bp, Homo sapiens
tgacagctgctattt

SEQ ID NO: 43674 - DNA, 15 bp, Homo sapiens
gacagctgctatttg

SEQ ID NO: 43675 - DNA, 15 bp, Homo sapiens
acagctgctatttgt

SEQ ID NO: 43676 - DNA, 15 bp, Homo sapiens
cagctgctatttgta

SEQ ID NO: 43677 - DNA, 15 bp, Homo sapiens
agctgctatttgtat

SEQ ID NO: 43678 - DNA, 15 bp, Homo sapiens
gctgctatttgtatg

SEQ ID NO: 43679 - DNA, 15 bp, Homo sapiens
ctgctatttgtatgt

SEQ ID NO: 43680 - DNA, 15 bp, Homo sapiens
tgctatttgtatgtg

SEQ ID NO: 43681 - DNA, 15 bp, Homo sapiens
gctatttgtatgtgg

SEQ ID NO: 43682 - DNA, 15 bp, Homo sapiens
ctatttgtatgtggt

SEQ ID NO: 43683 - DNA, 15 bp, Homo sapiens
tatttgtatgtggtt

SEQ ID NO: 43684 - DNA, 15 bp, Homo sapiens
atttgtatgtggttc

SEQ ID NO: 43685 - DNA, 15 bp, Homo sapiens
tttgtatgtggttca

SEQ ID NO: 43686 - DNA, 15 bp, Homo sapiens
ttgtatgtggttcac

SEQ ID NO: 43687 - DNA, 15 bp, Homo sapiens
tgtatgtggttcaca

SEQ ID NO: 43688 - DNA, 15 bp, Homo sapiens
gtatgtggttcacaa

SEQ ID NO: 43689 - DNA, 15 bp, Homo sapiens
tatgtggttcacaat

SEQ ID NO: 43690 - DNA, 15 bp, Homo sapiens
atgtggttcacaata

SEQ ID NO: 43691 - DNA, 15 bp, Homo sapiens
tgtggttcacaataa

SEQ ID NO: 43692 - DNA, 15 bp, Homo sapiens
gtggttcacaataaa

SEQ ID NO: 43693 - DNA, 15 bp, Homo sapiens
tggttcacaataaaa

SEQ ID NO: 43694 - DNA, 15 bp, Homo sapiens
ggttcacaataaaaa

SEQ ID NO: 43695 - DNA, 15 bp, Homo sapiens
gttcacaataaaaag

SEQ ID NO: 43696 - DNA, 15 bp, Homo sapiens
ttcacaataaaaagg

SEQ ID NO: 43697 - DNA, 15 bp, Homo sapiens
tcacaataaaaaggt

SEQ ID NO: 43698 - DNA, 15 bp, Homo sapiens
cacaataaaaaggtg

SEQ ID NO: 43699 - DNA, 15 bp, Homo sapiens
acaataaaaaggtgc

SEQ ID NO: 43700 - DNA, 15 bp, Homo sapiens
caataaaaaggtgcg

SEQ ID NO: 43701 - DNA, 15 bp, Homo sapiens
aataaaaaggtgcgt

SEQ ID NO: 43702 - DNA, 15 bp, Homo sapiens
ataaaaaggtgcgtg

SEQ ID NO: 43703 - DNA, 15 bp, Homo sapiens
taaaaaggtgcgtgt

SEQ ID NO: 43704 - DNA, 15 bp, Homo sapiens
aaaaaggtgcgtgtt

SEQ ID NO: 43705 - DNA, 15 bp, Homo sapiens
aaaaggtgcgtgttt

SEQ ID NO: 43706 - DNA, 15 bp, Homo sapiens
aaaggtgcgtgttta

SEQ ID NO: 43707 - DNA, 15 bp, Homo sapiens
aaggtgcgtgtttag

SEQ ID NO: 43708 - DNA, 15 bp, Homo sapiens
aggtgcgtgtttaga

SEQ ID NO: 43709 - DNA, 15 bp, Homo sapiens
ggtgcgtgtttagag

SEQ ID NO: 43710 - DNA, 15 bp, Homo sapiens
gtgcgtgtttagaga

SEQ ID NO: 43711 - DNA, 15 bp, Homo sapiens
tgcgtgtttagagag

SEQ ID NO: 43712 - DNA, 15 bp, Homo sapiens
gcgtgtttagagaga

SEQ ID NO: 43713 - DNA, 15 bp, Homo sapiens
cgtgtttagagagag

SEQ ID NO: 43714 - DNA, 15 bp, Homo sapiens
gtgtttagagagaga

SEQ ID NO: 43715 - DNA, 15 bp, Homo sapiens
tgtttagagagagag

SEQ ID NO: 43716 - DNA, 15 bp, Homo sapiens
gtttagagagagaga

SEQ ID NO: 43717 - DNA, 15 bp, Homo sapiens
tttagagagagagag

SEQ ID NO: 43718 - DNA, 15 bp, Homo sapiens
ttagagagagagaga

SEQ ID NO: 43719 - DNA, 15 bp, Homo sapiens
tagagagagagagaa

SEQ ID NO: 43720 - DNA, 15 bp, Homo sapiens
agagagagagagaaa

SEQ ID NO: 43721 - DNA, 15 bp, Homo sapiens
gagagagagagaaag

SEQ ID NO: 43722 - DNA, 15 bp, Homo sapiens
agagagagagaaagc

SEQ ID NO: 43723 - DNA, 15 bp, Homo sapiens
gagagagagaaagca

SEQ ID NO: 43724 - DNA, 15 bp, Homo sapiens
agagagagaaagcaa

SEQ ID NO: 43725 - DNA, 15 bp, Homo sapiens
gagagagaaagcaaa

SEQ ID NO: 43726 - DNA, 15 bp, Homo sapiens
agagagaaagcaaac

SEQ ID NO: 43727 - DNA, 15 bp, Homo sapiens
gagagaaagcaaaca

SEQ ID NO: 43728 - DNA, 15 bp, Homo sapiens
agagaaagcaaacat

SEQ ID NO: 43729 - DNA, 15 bp, Homo sapiens
gagaaagcaaacatg

SEQ ID NO: 43730 - DNA, 15 bp, Homo sapiens
agaaagcaaacatgg

SEQ ID NO: 43731 - DNA, 15 bp, Homo sapiens
gaaagcaaacatggc

SEQ ID NO: 43732 - DNA, 15 bp, Homo sapiens
aaagcaaacatggca

SEQ ID NO: 43733 - DNA, 15 bp, Homo sapiens
aagcaaacatggcaa

SEQ ID NO: 43734 - DNA, 15 bp, Homo sapiens
agcaaacatggcaaa

SEQ ID NO: 43735 - DNA, 15 bp, Homo sapiens
gcaaacatggcaaac

SEQ ID NO: 43736 - DNA, 15 bp, Homo sapiens
caaacatggcaaacc

SEQ ID NO: 43737 - DNA, 15 bp, Homo sapiens
aaacatggcaaacca

SEQ ID NO: 43738 - DNA, 15 bp, Homo sapiens
aacatggcaaaccat

SEQ ID NO: 43739 - DNA, 15 bp, Homo sapiens
acatggcaaaccatt

SEQ ID NO: 43740 - DNA, 15 bp, Homo sapiens
catggcaaaccatta

SEQ ID NO: 43741 - DNA, 15 bp, Homo sapiens
atggcaaaccattaa

SEQ ID NO: 43742 - DNA, 15 bp, Homo sapiens
tggcaaaccattaat

SEQ ID NO: 43743 - DNA, 15 bp, Homo sapiens
ggcaaaccattaata

SEQ ID NO: 43744 - DNA, 15 bp, Homo sapiens
gcaaaccattaataa

SEQ ID NO: 43745 - DNA, 15 bp, Homo sapiens
caaaccattaataat

SEQ ID NO: 43746 - DNA, 15 bp, Homo sapiens
aaaccattaataatg

SEQ ID NO: 43747 - DNA, 15 bp, Homo sapiens
aaccattaataatgg

SEQ ID NO: 43748 - DNA, 15 bp, Homo sapiens
accattaataatggt

SEQ ID NO: 43749 - DNA, 15 bp, Homo sapiens
ccattaataatggtg

SEQ ID NO: 43750 - DNA, 15 bp, Homo sapiens
cattaataatggtga

SEQ ID NO: 43751 - DNA, 15 bp, Homo sapiens
attaataatggtgag

SEQ ID NO: 43752 - DNA, 15 bp, Homo sapiens
ttaataatggtgagt

SEQ ID NO: 43753 - DNA, 15 bp, Homo sapiens
taataatggtgagtc

SEQ ID NO: 43754 - DNA, 15 bp, Homo sapiens
aataatggtgagtct

SEQ ID NO: 43755 - DNA, 15 bp, Homo sapiens
ataatggtgagtcta

SEQ ID NO: 43756 - DNA, 15 bp, Homo sapiens
taatggtgagtctag

SEQ ID NO: 43757 - DNA, 15 bp, Homo sapiens
aatggtgagtctagg

SEQ ID NO: 43758 - DNA, 15 bp, Homo sapiens
atggtgagtctaggt

SEQ ID NO: 43759 - DNA, 15 bp, Homo sapiens
tggtgagtctaggtg

SEQ ID NO: 43760 - DNA, 15 bp, Homo sapiens
ggtgagtctaggtgc

SEQ ID NO: 43761 - DNA, 15 bp, Homo sapiens
gtgagtctaggtgca

SEQ ID NO: 43762 - DNA, 15 bp, Homo sapiens
tgagtctaggtgcaa

SEQ ID NO: 43763 - DNA, 15 bp, Homo sapiens
gagtctaggtgcaaa

SEQ ID NO: 43764 - DNA, 15 bp, Homo sapiens
agtctaggtgcaaag

SEQ ID NO: 43765 - DNA, 15 bp, Homo sapiens
gtctaggtgcaaagt

SEQ ID NO: 43766 - DNA, 15 bp, Homo sapiens
tctaggtgcaaagta

SEQ ID NO: 43767 - DNA, 15 bp, Homo sapiens
ctaggtgcaaagtat

SEQ ID NO: 43768 - DNA, 15 bp, Homo sapiens
taggtgcaaagtata

SEQ ID NO: 43769 - DNA, 15 bp, Homo sapiens
aggtgcaaagtatat

SEQ ID NO: 43770 - DNA, 15 bp, Homo sapiens
ggtgcaaagtatatg

SEQ ID NO: 43771 - DNA, 15 bp, Homo sapiens
gtgcaaagtatatga

SEQ ID NO: 43772 - DNA, 15 bp, Homo sapiens
tgcaaagtatatgaa

SEQ ID NO: 43773 - DNA, 15 bp, Homo sapiens
gcaaagtatatgaat

SEQ ID NO: 43774 - DNA, 15 bp, Homo sapiens
caaagtatatgaatg

SEQ ID NO: 43775 - DNA, 15 bp, Homo sapiens
aaagtatatgaatgt

SEQ ID NO: 43776 - DNA, 15 bp, Homo sapiens
aagtatatgaatgtt

SEQ ID NO: 43777 - DNA, 15 bp, Homo sapiens
agtatatgaatgttc

SEQ ID NO: 43778 - DNA, 15 bp, Homo sapiens
gtatatgaatgttca

SEQ ID NO: 43779 - DNA, 15 bp, Homo sapiens
tatatgaatgttcat

SEQ ID NO: 43780 - DNA, 15 bp, Homo sapiens
atatgaatgttcatt

SEQ ID NO: 43781 - DNA, 15 bp, Homo sapiens
tatgaatgttcattt

SEQ ID NO: 43782 - DNA, 15 bp, Homo sapiens
atgaatgttcatttt

SEQ ID NO: 43783 - DNA, 15 bp, Homo sapiens
tgaatgttcatttta

SEQ ID NO: 43784 - DNA, 15 bp, Homo sapiens
gaatgttcattttac

SEQ ID NO: 43785 - DNA, 15 bp, Homo sapiens
aatgttcattttact

SEQ ID NO: 43786 - DNA, 15 bp, Homo sapiens
atgttcattttacta

SEQ ID NO: 43787 - DNA, 15 bp, Homo sapiens
tgttcattttactat

SEQ ID NO: 43788 - DNA, 15 bp, Homo sapiens
gttcattttactatt

SEQ ID NO: 43789 - DNA, 15 bp, Homo sapiens
ttcattttactattt

SEQ ID NO: 43790 - DNA, 15 bp, Homo sapiens
tcattttactatttc

SEQ ID NO: 43791 - DNA, 15 bp, Homo sapiens
cattttactatttca

SEQ ID NO: 43792 - DNA, 15 bp, Homo sapiens
attttactatttcac

SEQ ID NO: 43793 - DNA, 15 bp, Homo sapiens
ttttactatttcact

SEQ ID NO: 43794 - DNA, 15 bp, Homo sapiens
tttactatttcactt

SEQ ID NO: 43795 - DNA, 15 bp, Homo sapiens
ttactatttcacttt

SEQ ID NO: 43796 - DNA, 15 bp, Homo sapiens
tactatttcactttt

SEQ ID NO: 43797 - DNA, 15 bp, Homo sapiens
actatttcacttttt

SEQ ID NO: 43798 - DNA, 15 bp, Homo sapiens
ctatttcactttttc

SEQ ID NO: 43799 - DNA, 15 bp, Homo sapiens
tatttcactttttct

SEQ ID NO: 43800 - DNA, 15 bp, Homo sapiens
atttcactttttcta

SEQ ID NO: 43801 - DNA, 15 bp, Homo sapiens
tttcactttttctat

SEQ ID NO: 43802 - DNA, 15 bp, Homo sapiens
ttcactttttctatt

SEQ ID NO: 43803 - DNA, 15 bp, Homo sapiens
tcactttttctattg

SEQ ID NO: 43804 - DNA, 15 bp, Homo sapiens
cactttttctattga

SEQ ID NO: 43805 - DNA, 15 bp, Homo sapiens
actttttctattgat

SEQ ID NO: 43806 - DNA, 15 bp, Homo sapiens
ctttttctattgatg

SEQ ID NO: 43807 - DNA, 15 bp, Homo sapiens
tttttctattgatgt

SEQ ID NO: 43808 - DNA, 15 bp, Homo sapiens
ttttctattgatgtg

SEQ ID NO: 43809 - DNA, 15 bp, Homo sapiens
tttctattgatgtga

SEQ ID NO: 43810 - DNA, 15 bp, Homo sapiens
ttctattgatgtgaa

SEQ ID NO: 43811 - DNA, 15 bp, Homo sapiens
tctattgatgtgaaa

SEQ ID NO: 43812 - DNA, 15 bp, Homo sapiens
ctattgatgtgaaaa

SEQ ID NO: 43813 - DNA, 15 bp, Homo sapiens
tattgatgtgaaaaa

SEQ ID NO: 43814 - DNA, 15 bp, Homo sapiens
attgatgtgaaaaat

SEQ ID NO: 43815 - DNA, 15 bp, Homo sapiens
ttgatgtgaaaaatt

SEQ ID NO: 43816 - DNA, 15 bp, Homo sapiens
tgatgtgaaaaattc

SEQ ID NO: 43817 - DNA, 15 bp, Homo sapiens
gatgtgaaaaattct

SEQ ID NO: 43818 - DNA, 15 bp, Homo sapiens
atgtgaaaaattctt

SEQ ID NO: 43819 - DNA, 15 bp, Homo sapiens
tgtgaaaaattcttt

SEQ ID NO: 43820 - DNA, 15 bp, Homo sapiens
gtgaaaaattctttg

SEQ ID NO: 43821 - DNA, 15 bp, Homo sapiens
tgaaaaattctttga

SEQ ID NO: 43822 - DNA, 15 bp, Homo sapiens
gaaaaattctttgaa

SEQ ID NO: 43823 - DNA, 15 bp, Homo sapiens
aaaaattctttgaat

SEQ ID NO: 43824 - DNA, 15 bp, Homo sapiens
aaaattctttgaata

SEQ ID NO: 43825 - DNA, 15 bp, Homo sapiens
aaattctttgaatag

SEQ ID NO: 43826 - DNA, 15 bp, Homo sapiens
aattctttgaatagt

SEQ ID NO: 43827 - DNA, 15 bp, Homo sapiens
attctttgaatagtg

SEQ ID NO: 43828 - DNA, 15 bp, Homo sapiens
ttctttgaatagtga

SEQ ID NO: 43829 - DNA, 15 bp, Homo sapiens
tctttgaatagtgag

SEQ ID NO: 43830 - DNA, 15 bp, Homo sapiens
ctttgaatagtgagg

SEQ ID NO: 43831 - DNA, 15 bp, Homo sapiens
tttgaatagtgagga

SEQ ID NO: 43832 - DNA, 15 bp, Homo sapiens
ttgaatagtgaggaa

SEQ ID NO: 43833 - DNA, 15 bp, Homo sapiens
tgaatagtgaggaaa

SEQ ID NO: 43834 - DNA, 15 bp, Homo sapiens
gaatagtgaggaaat

SEQ ID NO: 43835 - DNA, 15 bp, Homo sapiens
aatagtgaggaaatg

SEQ ID NO: 43836 - DNA, 15 bp, Homo sapiens
atagtgaggaaatga

SEQ ID NO: 43837 - DNA, 15 bp, Homo sapiens
tagtgaggaaatgat

SEQ ID NO: 43838 - DNA, 15 bp, Homo sapiens
agtgaggaaatgatt

SEQ ID NO: 43839 - DNA, 15 bp, Homo sapiens
gtgaggaaatgattt

SEQ ID NO: 43840 - DNA, 15 bp, Homo sapiens
tgaggaaatgatttt

SEQ ID NO: 43841 - DNA, 15 bp, Homo sapiens
gaggaaatgatttta

SEQ ID NO: 43842 - DNA, 15 bp, Homo sapiens
aggaaatgattttaa

SEQ ID NO: 43843 - DNA, 15 bp, Homo sapiens
ggaaatgattttaag

SEQ ID NO: 43844 - DNA, 15 bp, Homo sapiens
gaaatgattttaagt

SEQ ID NO: 43845 - DNA, 15 bp, Homo sapiens
aaatgattttaagtt

SEQ ID NO: 43846 - DNA, 15 bp, Homo sapiens
aatgattttaagttg

SEQ ID NO: 43847 - DNA, 15 bp, Homo sapiens
atgattttaagttgg

SEQ ID NO: 43848 - DNA, 15 bp, Homo sapiens
tgattttaagttggg

SEQ ID NO: 43849 - DNA, 15 bp, Homo sapiens
gattttaagttgggg

SEQ ID NO: 43850 - DNA, 15 bp, Homo sapiens
attttaagttgggga

SEQ ID NO: 43851 - DNA, 15 bp, Homo sapiens
ttttaagttggggac

SEQ ID NO: 43852 - DNA, 15 bp, Homo sapiens
tttaagttggggaca

SEQ ID NO: 43853 - DNA, 15 bp, Homo sapiens
ttaagttggggacat

SEQ ID NO: 43854 - DNA, 15 bp, Homo sapiens
taagttggggacatt

SEQ ID NO: 43855 - DNA, 15 bp, Homo sapiens
aagttggggacattt

SEQ ID NO: 43856 - DNA, 15 bp, Homo sapiens
agttggggacatttg

SEQ ID NO: 43857 - DNA, 15 bp, Homo sapiens
gttggggacatttgt

SEQ ID NO: 43858 - DNA, 15 bp, Homo sapiens
ttggggacatttgtg

SEQ ID NO: 43859 - DNA, 15 bp, Homo sapiens
tggggacatttgtgg

SEQ ID NO: 43860 - DNA, 15 bp, Homo sapiens
ggggacatttgtggg

SEQ ID NO: 43861 - DNA, 15 bp, Homo sapiens
gggacatttgtgggt

SEQ ID NO: 43862 - DNA, 15 bp, Homo sapiens
ggacatttgtgggtt

SEQ ID NO: 43863 - DNA, 15 bp, Homo sapiens
gacatttgtgggttt

SEQ ID NO: 43864 - DNA, 15 bp, Homo sapiens
acatttgtgggtttg

SEQ ID NO: 43865 - DNA, 15 bp, Homo sapiens
catttgtgggtttgt

SEQ ID NO: 43866 - DNA, 15 bp, Homo sapiens
atttgtgggtttgta

SEQ ID NO: 43867 - DNA, 15 bp, Homo sapiens
tttgtgggtttgtat

SEQ ID NO: 43868 - DNA, 15 bp, Homo sapiens
ttgtgggtttgtatg

SEQ ID NO: 43869 - DNA, 15 bp, Homo sapiens
tgtgggtttgtatga

SEQ ID NO: 43870 - DNA, 15 bp, Homo sapiens
gtgggtttgtatgag

SEQ ID NO: 43871 - DNA, 15 bp, Homo sapiens
tgggtttgtatgaga

SEQ ID NO: 43872 - DNA, 15 bp, Homo sapiens
gggtttgtatgagaa

SEQ ID NO: 43873 - DNA, 15 bp, Homo sapiens
ggtttgtatgagaac

SEQ ID NO: 43874 - DNA, 15 bp, Homo sapiens
gtttgtatgagaacc

SEQ ID NO: 43875 - DNA, 15 bp, Homo sapiens
tttgtatgagaacct

SEQ ID NO: 43876 - DNA, 15 bp, Homo sapiens
ttgtatgagaacctg

SEQ ID NO: 43877 - DNA, 15 bp, Homo sapiens
tgtatgagaacctga

SEQ ID NO: 43878 - DNA, 15 bp, Homo sapiens
gtatgagaacctgac

SEQ ID NO: 43879 - DNA, 15 bp, Homo sapiens
tatgagaacctgact

SEQ ID NO: 43880 - DNA, 15 bp, Homo sapiens
atgagaacctgacta

SEQ ID NO: 43881 - DNA, 15 bp, Homo sapiens
tgagaacctgactac

SEQ ID NO: 43882 - DNA, 15 bp, Homo sapiens
gagaacctgactact

SEQ ID NO: 43883 - DNA, 15 bp, Homo sapiens
agaacctgactacta

SEQ ID NO: 43884 - DNA, 15 bp, Homo sapiens
gaacctgactactac

SEQ ID NO: 43885 - DNA, 15 bp, Homo sapiens
aacctgactactacc

SEQ ID NO: 43886 - DNA, 15 bp, Homo sapiens
acctgactactaccc

SEQ ID NO: 43887 - DNA, 15 bp, Homo sapiens
cctgactactaccca

SEQ ID NO: 43888 - DNA, 15 bp, Homo sapiens
ctgactactacccat

SEQ ID NO: 43889 - DNA, 15 bp, Homo sapiens
tgactactacccata

SEQ ID NO: 43890 - DNA, 15 bp, Homo sapiens
gactactacccatag

SEQ ID NO: 43891 - DNA, 15 bp, Homo sapiens
actactacccatagt

SEQ ID NO: 43892 - DNA, 15 bp, Homo sapiens
ctactacccatagta

SEQ ID NO: 43893 - DNA, 15 bp, Homo sapiens
tactacccatagtaa

SEQ ID NO: 43894 - DNA, 15 bp, Homo sapiens
actacccatagtaag

SEQ ID NO: 43895 - DNA, 15 bp, Homo sapiens
ctacccatagtaagt

SEQ ID NO: 43896 - DNA, 15 bp, Homo sapiens
tacccatagtaagta

SEQ ID NO: 43897 - DNA, 15 bp, Homo sapiens
acccatagtaagtaa

SEQ ID NO: 43898 - DNA, 15 bp, Homo sapiens
cccatagtaagtaaa

SEQ ID NO: 43899 - DNA, 15 bp, Homo sapiens
ccatagtaagtaaat

SEQ ID NO: 43900 - DNA, 15 bp, Homo sapiens
catagtaagtaaata

SEQ ID NO: 43901 - DNA, 15 bp, Homo sapiens
atagtaagtaaatag

SEQ ID NO: 43902 - DNA, 15 bp, Homo sapiens
tagtaagtaaataga

SEQ ID NO: 43903 - DNA, 15 bp, Homo sapiens
agtaagtaaatagag

SEQ ID NO: 43904 - DNA, 15 bp, Homo sapiens
gtaagtaaatagagg

SEQ ID NO: 43905 - DNA, 15 bp, Homo sapiens
taagtaaatagaggt

SEQ ID NO: 43906 - DNA, 15 bp, Homo sapiens
aagtaaatagaggta

SEQ ID NO: 43907 - DNA, 15 bp, Homo sapiens
agtaaatagaggtac

SEQ ID NO: 43908 - DNA, 15 bp, Homo sapiens
gtaaatagaggtacc

SEQ ID NO: 43909 - DNA, 15 bp, Homo sapiens
taaatagaggtaccc

SEQ ID NO: 43910 - DNA, 15 bp, Homo sapiens
aaatagaggtaccct

SEQ ID NO: 43911 - DNA, 15 bp, Homo sapiens
aatagaggtaccctg

SEQ ID NO: 43912 - DNA, 15 bp, Homo sapiens
atagaggtaccctga

SEQ ID NO: 43913 - DNA, 15 bp, Homo sapiens
tagaggtaccctgaa

SEQ ID NO: 43914 - DNA, 15 bp, Homo sapiens
agaggtaccctgaaa

SEQ ID NO: 43915 - DNA, 15 bp, Homo sapiens
gaggtaccctgaaaa

SEQ ID NO: 43916 - DNA, 15 bp, Homo sapiens
aggtaccctgaaaat

SEQ ID NO: 43917 - DNA, 15 bp, Homo sapiens
ggtaccctgaaaata

SEQ ID NO: 43918 - DNA, 15 bp, Homo sapiens
gtaccctgaaaatag

SEQ ID NO: 43919 - DNA, 15 bp, Homo sapiens
taccctgaaaatagt

SEQ ID NO: 43920 - DNA, 15 bp, Homo sapiens
accctgaaaatagtg

SEQ ID NO: 43921 - DNA, 15 bp, Homo sapiens
ccctgaaaatagtga

SEQ ID NO: 43922 - DNA, 15 bp, Homo sapiens
cctgaaaatagtgaa

SEQ ID NO: 43923 - DNA, 15 bp, Homo sapiens
ctgaaaatagtgaag

SEQ ID NO: 43924 - DNA, 15 bp, Homo sapiens
tgaaaatagtgaagc

SEQ ID NO: 43925 - DNA, 15 bp, Homo sapiens
gaaaatagtgaagcc

SEQ ID NO: 43926 - DNA, 15 bp, Homo sapiens
aaaatagtgaagcca

SEQ ID NO: 43927 - DNA, 15 bp, Homo sapiens
aaatagtgaagccat

SEQ ID NO: 43928 - DNA, 15 bp, Homo sapiens
aatagtgaagccatg

SEQ ID NO: 43929 - DNA, 15 bp, Homo sapiens
atagtgaagccatgt

SEQ ID NO: 43930 - DNA, 15 bp, Homo sapiens
tagtgaagccatgtc

SEQ ID NO: 43931 - DNA, 15 bp, Homo sapiens
agtgaagccatgtcc

SEQ ID NO: 43932 - DNA, 15 bp, Homo sapiens
gtgaagccatgtcct

SEQ ID NO: 43933 - DNA, 15 bp, Homo sapiens
tgaagccatgtcctt

SEQ ID NO: 43934 - DNA, 15 bp, Homo sapiens
gaagccatgtccttc

SEQ ID NO: 43935 - DNA, 15 bp, Homo sapiens
aagccatgtccttct

SEQ ID NO: 43936 - DNA, 15 bp, Homo sapiens
agccatgtccttctc

SEQ ID NO: 43937 - DNA, 15 bp, Homo sapiens
gccatgtccttctct

SEQ ID NO: 43938 - DNA, 15 bp, Homo sapiens
ccatgtccttctctt

SEQ ID NO: 43939 - DNA, 15 bp, Homo sapiens
catgtccttctctta

SEQ ID NO: 43940 - DNA, 15 bp, Homo sapiens
atgtccttctcttat

SEQ ID NO: 43941 - DNA, 15 bp, Homo sapiens
tgtccttctcttata

SEQ ID NO: 43942 - DNA, 15 bp, Homo sapiens
gtccttctcttataa

SEQ ID NO: 43943 - DNA, 15 bp, Homo sapiens
tccttctcttataac

SEQ ID NO: 43944 - DNA, 15 bp, Homo sapiens
ccttctcttataaca

SEQ ID NO: 43945 - DNA, 15 bp, Homo sapiens
cttctcttataacac

SEQ ID NO: 43946 - DNA, 15 bp, Homo sapiens
ttctcttataacact

SEQ ID NO: 43947 - DNA, 15 bp, Homo sapiens
tctcttataacacta

SEQ ID NO: 43948 - DNA, 15 bp, Homo sapiens
ctcttataacactag

SEQ ID NO: 43949 - DNA, 15 bp, Homo sapiens
tcttataacactagg

SEQ ID NO: 43950 - DNA, 15 bp, Homo sapiens
cttataacactagga

SEQ ID NO: 43951 - DNA, 15 bp, Homo sapiens
ttataacactaggaa

SEQ ID NO: 43952 - DNA, 15 bp, Homo sapiens
tataacactaggaat

SEQ ID NO: 43953 - DNA, 15 bp, Homo sapiens
ataacactaggaatt

SEQ ID NO: 43954 - DNA, 15 bp, Homo sapiens
taacactaggaatta

SEQ ID NO: 43955 - DNA, 15 bp, Homo sapiens
aacactaggaattaa

SEQ ID NO: 43956 - DNA, 15 bp, Homo sapiens
acactaggaattaaa

SEQ ID NO: 43957 - DNA, 15 bp, Homo sapiens
cactaggaattaaag

SEQ ID NO: 43958 - DNA, 15 bp, Homo sapiens
actaggaattaaagt

SEQ ID NO: 43959 - DNA, 15 bp, Homo sapiens
ctaggaattaaagtg

SEQ ID NO: 43960 - DNA, 15 bp, Homo sapiens
taggaattaaagtgg

SEQ ID NO: 43961 - DNA, 15 bp, Homo sapiens
aggaattaaagtggc

SEQ ID NO: 43962 - DNA, 15 bp, Homo sapiens
ggaattaaagtggca

SEQ ID NO: 43963 - DNA, 15 bp, Homo sapiens
gaattaaagtggcat

SEQ ID NO: 43964 - DNA, 15 bp, Homo sapiens
aattaaagtggcatg

SEQ ID NO: 43965 - DNA, 15 bp, Homo sapiens
attaaagtggcatgg

SEQ ID NO: 43966 - DNA, 15 bp, Homo sapiens
ttaaagtggcatggg

SEQ ID NO: 43967 - DNA, 15 bp, Homo sapiens
taaagtggcatggga

SEQ ID NO: 43968 - DNA, 15 bp, Homo sapiens
aaagtggcatgggag

SEQ ID NO: 43969 - DNA, 15 bp, Homo sapiens
aagtggcatgggaga

SEQ ID NO: 43970 - DNA, 15 bp, Homo sapiens
agtggcatgggagag

SEQ ID NO: 43971 - DNA, 15 bp, Homo sapiens
gtggcatgggagaga

SEQ ID NO: 43972 - DNA, 15 bp, Homo sapiens
tggcatgggagagac

SEQ ID NO: 43973 - DNA, 15 bp, Homo sapiens
ggcatgggagagact

SEQ ID NO: 43974 - DNA, 15 bp, Homo sapiens
gcatgggagagactg

SEQ ID NO: 43975 - DNA, 15 bp, Homo sapiens
catgggagagactgc

SEQ ID NO: 43976 - DNA, 15 bp, Homo sapiens
atgggagagactgct

SEQ ID NO: 43977 - DNA, 15 bp, Homo sapiens
tgggagagactgctc

SEQ ID NO: 43978 - DNA, 15 bp, Homo sapiens
gggagagactgctca

SEQ ID NO: 43979 - DNA, 15 bp, Homo sapiens
ggagagactgctcac

SEQ ID NO: 43980 - DNA, 15 bp, Homo sapiens
gagagactgctcaca

SEQ ID NO: 43981 - DNA, 15 bp, Homo sapiens
agagactgctcacat

SEQ ID NO: 43982 - DNA, 15 bp, Homo sapiens
gagactgctcacatt

SEQ ID NO: 43983 - DNA, 15 bp, Homo sapiens
agactgctcacattt

SEQ ID NO: 43984 - DNA, 15 bp, Homo sapiens
gactgctcacatttg

SEQ ID NO: 43985 - DNA, 15 bp, Homo sapiens
actgctcacatttga

SEQ ID NO: 43986 - DNA, 15 bp, Homo sapiens
ctgctcacatttgat

SEQ ID NO: 43987 - DNA, 15 bp, Homo sapiens
tgctcacatttgatt

SEQ ID NO: 43988 - DNA, 15 bp, Homo sapiens
gctcacatttgattt

SEQ ID NO: 43989 - DNA, 15 bp, Homo sapiens
ctcacatttgatttc

SEQ ID NO: 43990 - DNA, 15 bp, Homo sapiens
tcacatttgatttct

SEQ ID NO: 43991 - DNA, 15 bp, Homo sapiens
cacatttgatttctt

SEQ ID NO: 43992 - DNA, 15 bp, Homo sapiens
acatttgatttcttt

SEQ ID NO: 43993 - DNA, 15 bp, Homo sapiens
catttgatttctttg

SEQ ID NO: 43994 - DNA, 15 bp, Homo sapiens
atttgatttctttgg

SEQ ID NO: 43995 - DNA, 15 bp, Homo sapiens
tttgatttctttggt

SEQ ID NO: 43996 - DNA, 15 bp, Homo sapiens
ttgatttctttggtt

SEQ ID NO: 43997 - DNA, 15 bp, Homo sapiens
tgatttctttggttt

SEQ ID NO: 43998 - DNA, 15 bp, Homo sapiens
gatttctttggtttt

SEQ ID NO: 43999 - DNA, 15 bp, Homo sapiens
atttctttggttttt

SEQ ID NO: 44000 - DNA, 15 bp, Homo sapiens
tttctttggtttttg

SEQ ID NO: 44001 - DNA, 15 bp, Homo sapiens
ttctttggtttttgg

SEQ ID NO: 44002 - DNA, 15 bp, Homo sapiens
tctttggtttttgga

SEQ ID NO: 44003 - DNA, 15 bp, Homo sapiens
ctttggtttttggac

SEQ ID NO: 44004 - DNA, 15 bp, Homo sapiens
tttggtttttggacc

SEQ ID NO: 44005 - DNA, 15 bp, Homo sapiens
ttggtttttggaccc

SEQ ID NO: 44006 - DNA, 15 bp, Homo sapiens
tggtttttggaccct

SEQ ID NO: 44007 - DNA, 15 bp, Homo sapiens
ggtttttggaccctg

SEQ ID NO: 44008 - DNA, 15 bp, Homo sapiens
gtttttggaccctgt

SEQ ID NO: 44009 - DNA, 15 bp, Homo sapiens
tttttggaccctgtc

SEQ ID NO: 44010 - DNA, 15 bp, Homo sapiens
ttttggaccctgtca

SEQ ID NO: 44011 - DNA, 15 bp, Homo sapiens
tttggaccctgtcac

SEQ ID NO: 44012 - DNA, 15 bp, Homo sapiens
ttggaccctgtcaca

SEQ ID NO: 44013 - DNA, 15 bp, Homo sapiens
tggaccctgtcacat

SEQ ID NO: 44014 - DNA, 15 bp, Homo sapiens
ggaccctgtcacatg

SEQ ID NO: 44015 - DNA, 15 bp, Homo sapiens
gaccctgtcacatga

SEQ ID NO: 44016 - DNA, 15 bp, Homo sapiens
accctgtcacatgag

SEQ ID NO: 44017 - DNA, 15 bp, Homo sapiens
ccctgtcacatgagt

SEQ ID NO: 44018 - DNA, 15 bp, Homo sapiens
cctgtcacatgagta

SEQ ID NO: 44019 - DNA, 15 bp, Homo sapiens
ctgtcacatgagtag

SEQ ID NO: 44020 - DNA, 15 bp, Homo sapiens
tgtcacatgagtagg

SEQ ID NO: 44021 - DNA, 15 bp, Homo sapiens
gtcacatgagtaggg

SEQ ID NO: 44022 - DNA, 15 bp, Homo sapiens
tcacatgagtagggg

SEQ ID NO: 44023 - DNA, 15 bp, Homo sapiens
cacatgagtaggggt

SEQ ID NO: 44024 - DNA, 15 bp, Homo sapiens
acatgagtaggggtt

SEQ ID NO: 44025 - DNA, 15 bp, Homo sapiens
catgagtaggggttg

SEQ ID NO: 44026 - DNA, 15 bp, Homo sapiens
atgagtaggggttgt

SEQ ID NO: 44027 - DNA, 15 bp, Homo sapiens
tgagtaggggttgtc

SEQ ID NO: 44028 - DNA, 15 bp, Homo sapiens
gagtaggggttgtca

SEQ ID NO: 44029 - DNA, 15 bp, Homo sapiens
agtaggggttgtcaa

SEQ ID NO: 44030 - DNA, 15 bp, Homo sapiens
gtaggggttgtcaag

SEQ ID NO: 44031 - DNA, 15 bp, Homo sapiens
taggggttgtcaaga

SEQ ID NO: 44032 - DNA, 15 bp, Homo sapiens
aggggttgtcaagat

SEQ ID NO: 44033 - DNA, 15 bp, Homo sapiens
ggggttgtcaagata

SEQ ID NO: 44034 - DNA, 15 bp, Homo sapiens
gggttgtcaagatag

SEQ ID NO: 44035 - DNA, 15 bp, Homo sapiens
ggttgtcaagatagc

SEQ ID NO: 44036 - DNA, 15 bp, Homo sapiens
gttgtcaagatagcc

SEQ ID NO: 44037 - DNA, 15 bp, Homo sapiens
ttgtcaagatagccc

SEQ ID NO: 44038 - DNA, 15 bp, Homo sapiens
tgtcaagatagccca

SEQ ID NO: 44039 - DNA, 15 bp, Homo sapiens
gtcaagatagcccat

SEQ ID NO: 44040 - DNA, 15 bp, Homo sapiens
tcaagatagcccatg

SEQ ID NO: 44041 - DNA, 15 bp, Homo sapiens
caagatagcccatgg

SEQ ID NO: 44042 - DNA, 15 bp, Homo sapiens
aagatagcccatggg

SEQ ID NO: 44043 - DNA, 15 bp, Homo sapiens
agatagcccatgggg

SEQ ID NO: 44044 - DNA, 15 bp, Homo sapiens
gatagcccatggggc

SEQ ID NO: 44045 - DNA, 15 bp, Homo sapiens
atagcccatggggct

SEQ ID NO: 44046 - DNA, 15 bp, Homo sapiens
tagcccatggggcta

SEQ ID NO: 44047 - DNA, 15 bp, Homo sapiens
agcccatggggctag

SEQ ID NO: 44048 - DNA, 15 bp, Homo sapiens
gcccatggggctagt

SEQ ID NO: 44049 - DNA, 15 bp, Homo sapiens
cccatggggctagtt

SEQ ID NO: 44050 - DNA, 15 bp, Homo sapiens
ccatggggctagttg

SEQ ID NO: 44051 - DNA, 15 bp, Homo sapiens
catggggctagttgc

SEQ ID NO: 44052 - DNA, 15 bp, Homo sapiens
atggggctagttgcc

SEQ ID NO: 44053 - DNA, 15 bp, Homo sapiens
tggggctagttgccg

SEQ ID NO: 44054 - DNA, 15 bp, Homo sapiens
ggggctagttgccgt

SEQ ID NO: 44055 - DNA, 15 bp, Homo sapiens
gggctagttgccgtt

SEQ ID NO: 44056 - DNA, 15 bp, Homo sapiens
ggctagttgccgttt

SEQ ID NO: 44057 - DNA, 15 bp, Homo sapiens
gctagttgccgtttc

SEQ ID NO: 44058 - DNA, 15 bp, Homo sapiens
ctagttgccgtttct

SEQ ID NO: 44059 - DNA, 15 bp, Homo sapiens
tagttgccgtttcta

SEQ ID NO: 44060 - DNA, 15 bp, Homo sapiens
agttgccgtttctat

SEQ ID NO: 44061 - DNA, 15 bp, Homo sapiens
gttgccgtttctatt

SEQ ID NO: 44062 - DNA, 15 bp, Homo sapiens
ttgccgtttctatta

SEQ ID NO: 44063 - DNA, 15 bp, Homo sapiens
tgccgtttctattac

SEQ ID NO: 44064 - DNA, 15 bp, Homo sapiens
gccgtttctattaca

SEQ ID NO: 44065 - DNA, 15 bp, Homo sapiens
ccgtttctattacag

SEQ ID NO: 44066 - DNA, 15 bp, Homo sapiens
cgtttctattacagt

SEQ ID NO: 44067 - DNA, 15 bp, Homo sapiens
gtttctattacagtg

SEQ ID NO: 44068 - DNA, 15 bp, Homo sapiens
tttctattacagtga

SEQ ID NO: 44069 - DNA, 15 bp, Homo sapiens
ttctattacagtgag

SEQ ID NO: 44070 - DNA, 15 bp, Homo sapiens
tctattacagtgaga

SEQ ID NO: 44071 - DNA, 15 bp, Homo sapiens
ctattacagtgagaa

SEQ ID NO: 44072 - DNA, 15 bp, Homo sapiens
tattacagtgagaaa

SEQ ID NO: 44073 - DNA, 15 bp, Homo sapiens
attacagtgagaaaa

SEQ ID NO: 44074 - DNA, 15 bp, Homo sapiens
ttacagtgagaaaag

SEQ ID NO: 44075 - DNA, 15 bp, Homo sapiens
tacagtgagaaaagt

SEQ ID NO: 44076 - DNA, 15 bp, Homo sapiens
acagtgagaaaagta

SEQ ID NO: 44077 - DNA, 15 bp, Homo sapiens
cagtgagaaaagtag

SEQ ID NO: 44078 - DNA, 15 bp, Homo sapiens
agtgagaaaagtagg

SEQ ID NO: 44079 - DNA, 15 bp, Homo sapiens
gtgagaaaagtaggg

SEQ ID NO: 44080 - DNA, 15 bp, Homo sapiens
tgagaaaagtagggg

SEQ ID NO: 44081 - DNA, 15 bp, Homo sapiens
gagaaaagtaggggc

SEQ ID NO: 44082 - DNA, 15 bp, Homo sapiens
agaaaagtaggggcc

SEQ ID NO: 44083 - DNA, 15 bp, Homo sapiens
gaaaagtaggggcct

SEQ ID NO: 44084 - DNA, 15 bp, Homo sapiens
aaaagtaggggcctt

SEQ ID NO: 44085 - DNA, 15 bp, Homo sapiens
aaagtaggggccttg

SEQ ID NO: 44086 - DNA, 15 bp, Homo sapiens
aagtaggggccttga

SEQ ID NO: 44087 - DNA, 15 bp, Homo sapiens
agtaggggccttgag

SEQ ID NO: 44088 - DNA, 15 bp, Homo sapiens
gtaggggccttgagt

SEQ ID NO: 44089 - DNA, 15 bp, Homo sapiens
taggggccttgagtt

SEQ ID NO: 44090 - DNA, 15 bp, Homo sapiens
aggggccttgagttg

SEQ ID NO: 44091 - DNA, 15 bp, Homo sapiens
ggggccttgagttgt

SEQ ID NO: 44092 - DNA, 15 bp, Homo sapiens
gggccttgagttgtt

SEQ ID NO: 44093 - DNA, 15 bp, Homo sapiens
ggccttgagttgttg

SEQ ID NO: 44094 - DNA, 15 bp, Homo sapiens
gccttgagttgttgg

SEQ ID NO: 44095 - DNA, 15 bp, Homo sapiens
ccttgagttgttgga

SEQ ID NO: 44096 - DNA, 15 bp, Homo sapiens
cttgagttgttggag

SEQ ID NO: 44097 - DNA, 15 bp, Homo sapiens
ttgagttgttggagc

SEQ ID NO: 44098 - DNA, 15 bp, Homo sapiens
tgagttgttggagcc

SEQ ID NO: 44099 - DNA, 15 bp, Homo sapiens
gagttgttggagcca

SEQ ID NO: 44100 - DNA, 15 bp, Homo sapiens
agttgttggagccag

SEQ ID NO: 44101 - DNA, 15 bp, Homo sapiens
gttgttggagccaga

SEQ ID NO: 44102 - DNA, 15 bp, Homo sapiens
ttgttggagccagaa

SEQ ID NO: 44103 - DNA, 15 bp, Homo sapiens
tgttggagccagaag

SEQ ID NO: 44104 - DNA, 15 bp, Homo sapiens
gttggagccagaagt

SEQ ID NO: 44105 - DNA, 15 bp, Homo sapiens
ttggagccagaagtg

SEQ ID NO: 44106 - DNA, 15 bp, Homo sapiens
tggagccagaagtgg

SEQ ID NO: 44107 - DNA, 15 bp, Homo sapiens
ggagccagaagtgga

SEQ ID NO: 44108 - DNA, 15 bp, Homo sapiens
gagccagaagtggag

SEQ ID NO: 44109 - DNA, 15 bp, Homo sapiens
agccagaagtggaga

SEQ ID NO: 44110 - DNA, 15 bp, Homo sapiens
gccagaagtggagaa

SEQ ID NO: 44111 - DNA, 15 bp, Homo sapiens
ccagaagtggagaat

SEQ ID NO: 44112 - DNA, 15 bp, Homo sapiens
cagaagtggagaatg

SEQ ID NO: 44113 - DNA, 15 bp, Homo sapiens
agaagtggagaatgc

SEQ ID NO: 44114 - DNA, 15 bp, Homo sapiens
gaagtggagaatgct

SEQ ID NO: 44115 - DNA, 15 bp, Homo sapiens
aagtggagaatgctt

SEQ ID NO: 44116 - DNA, 15 bp, Homo sapiens
agtggagaatgctta

SEQ ID NO: 44117 - DNA, 15 bp, Homo sapiens
gtggagaatgcttag

SEQ ID NO: 44118 - DNA, 15 bp, Homo sapiens
tggagaatgcttaga

SEQ ID NO: 44119 - DNA, 15 bp, Homo sapiens
ggagaatgcttagag

SEQ ID NO: 44120 - DNA, 15 bp, Homo sapiens
gagaatgcttagagt

SEQ ID NO: 44121 - DNA, 15 bp, Homo sapiens
agaatgcttagagtt

SEQ ID NO: 44122 - DNA, 15 bp, Homo sapiens
gaatgcttagagttg

SEQ ID NO: 44123 - DNA, 15 bp, Homo sapiens
aatgcttagagttga

SEQ ID NO: 44124 - DNA, 15 bp, Homo sapiens
atgcttagagttgaa

SEQ ID NO: 44125 - DNA, 15 bp, Homo sapiens
tgcttagagttgaac

SEQ ID NO: 44126 - DNA, 15 bp, Homo sapiens
gcttagagttgaact

SEQ ID NO: 44127 - DNA, 15 bp, Homo sapiens
cttagagttgaacta

SEQ ID NO: 44128 - DNA, 15 bp, Homo sapiens
ttagagttgaactat

SEQ ID NO: 44129 - DNA, 15 bp, Homo sapiens
tagagttgaactata

SEQ ID NO: 44130 - DNA, 15 bp, Homo sapiens
agagttgaactatat

SEQ ID NO: 44131 - DNA, 15 bp, Homo sapiens
gagttgaactatatg

SEQ ID NO: 44132 - DNA, 15 bp, Homo sapiens
agttgaactatatga

SEQ ID NO: 44133 - DNA, 15 bp, Homo sapiens
gttgaactatatgag

SEQ ID NO: 44134 - DNA, 15 bp, Homo sapiens
ttgaactatatgagt

SEQ ID NO: 44135 - DNA, 15 bp, Homo sapiens
tgaactatatgagtt

SEQ ID NO: 44136 - DNA, 15 bp, Homo sapiens
gaactatatgagttt

SEQ ID NO: 44137 - DNA, 15 bp, Homo sapiens
aactatatgagtttg

SEQ ID NO: 44138 - DNA, 15 bp, Homo sapiens
actatatgagtttga

SEQ ID NO: 44139 - DNA, 15 bp, Homo sapiens
ctatatgagtttgaa

SEQ ID NO: 44140 - DNA, 15 bp, Homo sapiens
tatatgagtttgaaa

SEQ ID NO: 44141 - DNA, 15 bp, Homo sapiens
atatgagtttgaaaa

SEQ ID NO: 44142 - DNA, 15 bp, Homo sapiens
tatgagtttgaaaaa

SEQ ID NO: 44143 - DNA, 15 bp, Homo sapiens
atgagtttgaaaaat

SEQ ID NO: 44144 - DNA, 15 bp, Homo sapiens
tgagtttgaaaaatt

SEQ ID NO: 44145 - DNA, 15 bp, Homo sapiens
gagtttgaaaaattg

SEQ ID NO: 44146 - DNA, 15 bp, Homo sapiens
agtttgaaaaattgg

SEQ ID NO: 44147 - DNA, 15 bp, Homo sapiens
gtttgaaaaattggg

SEQ ID NO: 44148 - DNA, 15 bp, Homo sapiens
tttgaaaaattggga

SEQ ID NO: 44149 - DNA, 15 bp, Homo sapiens
ttgaaaaattgggaa

SEQ ID NO: 44150 - DNA, 15 bp, Homo sapiens
tgaaaaattgggaac

SEQ ID NO: 44151 - DNA, 15 bp, Homo sapiens
gaaaaattgggaaca

SEQ ID NO: 44152 - DNA, 15 bp, Homo sapiens
aaaaattgggaacac

SEQ ID NO: 44153 - DNA, 15 bp, Homo sapiens
aaaattgggaacaca

SEQ ID NO: 44154 - DNA, 15 bp, Homo sapiens
aaattgggaacacag

SEQ ID NO: 44155 - DNA, 15 bp, Homo sapiens
aattgggaacacaga

SEQ ID NO: 44156 - DNA, 15 bp, Homo sapiens
attgggaacacagag

SEQ ID NO: 44157 - DNA, 15 bp, Homo sapiens
ttgggaacacagagg

SEQ ID NO: 44158 - DNA, 15 bp, Homo sapiens
tgggaacacagaggg

SEQ ID NO: 44159 - DNA, 15 bp, Homo sapiens
gggaacacagagggg

SEQ ID NO: 44160 - DNA, 15 bp, Homo sapiens
ggaacacagaggggt

SEQ ID NO: 44161 - DNA, 15 bp, Homo sapiens
gaacacagaggggtt

SEQ ID NO: 44162 - DNA, 15 bp, Homo sapiens
aacacagaggggtta

SEQ ID NO: 44163 - DNA, 15 bp, Homo sapiens
acacagaggggttaa

SEQ ID NO: 44164 - DNA, 15 bp, Homo sapiens
cacagaggggttaag

SEQ ID NO: 44165 - DNA, 15 bp, Homo sapiens
acagaggggttaaga

SEQ ID NO: 44166 - DNA, 15 bp, Homo sapiens
cagaggggttaagag

SEQ ID NO: 44167 - DNA, 15 bp, Homo sapiens
agaggggttaagagc

SEQ ID NO: 44168 - DNA, 15 bp, Homo sapiens
gaggggttaagagca

SEQ ID NO: 44169 - DNA, 15 bp, Homo sapiens
aggggttaagagcac

SEQ ID NO: 44170 - DNA, 15 bp, Homo sapiens
ggggttaagagcact

SEQ ID NO: 44171 - DNA, 15 bp, Homo sapiens
gggttaagagcactg

SEQ ID NO: 44172 - DNA, 15 bp, Homo sapiens
ggttaagagcactgc

SEQ ID NO: 44173 - DNA, 15 bp, Homo sapiens
gttaagagcactgct

SEQ ID NO: 44174 - DNA, 15 bp, Homo sapiens
ttaagagcactgctt

SEQ ID NO: 44175 - DNA, 15 bp, Homo sapiens
taagagcactgcttg

SEQ ID NO: 44176 - DNA, 15 bp, Homo sapiens
aagagcactgcttga

SEQ ID NO: 44177 - DNA, 15 bp, Homo sapiens
agagcactgcttgaa

SEQ ID NO: 44178 - DNA, 15 bp, Homo sapiens
gagcactgcttgaag

SEQ ID NO: 44179 - DNA, 15 bp, Homo sapiens
agcactgcttgaaga

SEQ ID NO: 44180 - DNA, 15 bp, Homo sapiens
gcactgcttgaagat

SEQ ID NO: 44181 - DNA, 15 bp, Homo sapiens
cactgcttgaagatg

SEQ ID NO: 44182 - DNA, 15 bp, Homo sapiens
actgcttgaagatgg

SEQ ID NO: 44183 - DNA, 15 bp, Homo sapiens
ctgcttgaagatggt

SEQ ID NO: 44184 - DNA, 15 bp, Homo sapiens
tgcttgaagatggtc

SEQ ID NO: 44185 - DNA, 15 bp, Homo sapiens
gcttgaagatggtct

SEQ ID NO: 44186 - DNA, 15 bp, Homo sapiens
cttgaagatggtctg

SEQ ID NO: 44187 - DNA, 15 bp, Homo sapiens
ttgaagatggtctgc

SEQ ID NO: 44188 - DNA, 15 bp, Homo sapiens
tgaagatggtctgca

SEQ ID NO: 44189 - DNA, 15 bp, Homo sapiens
gaagatggtctgcaa

SEQ ID NO: 44190 - DNA, 15 bp, Homo sapiens
aagatggtctgcaag

SEQ ID NO: 44191 - DNA, 15 bp, Homo sapiens
agatggtctgcaagc

SEQ ID NO: 44192 - DNA, 15 bp, Homo sapiens
gatggtctgcaagcc

SEQ ID NO: 44193 - DNA, 15 bp, Homo sapiens
atggtctgcaagccg

SEQ ID NO: 44194 - DNA, 15 bp, Homo sapiens
tggtctgcaagccgg

SEQ ID NO: 44195 - DNA, 15 bp, Homo sapiens
ggtctgcaagccggg

SEQ ID NO: 44196 - DNA, 15 bp, Homo sapiens
gtctgcaagccgggc

SEQ ID NO: 44197 - DNA, 15 bp, Homo sapiens
tctgcaagccgggct

SEQ ID NO: 44198 - DNA, 15 bp, Homo sapiens
ctgcaagccgggctc

SEQ ID NO: 44199 - DNA, 15 bp, Homo sapiens
tgcaagccgggctca

SEQ ID NO: 44200 - DNA, 15 bp, Homo sapiens
gcaagccgggctcaa

SEQ ID NO: 44201 - DNA, 15 bp, Homo sapiens
caagccgggctcaaa

SEQ ID NO: 44202 - DNA, 15 bp, Homo sapiens
aagccgggctcaaat

SEQ ID NO: 44203 - DNA, 15 bp, Homo sapiens
agccgggctcaaata

SEQ ID NO: 44204 - DNA, 15 bp, Homo sapiens
gccgggctcaaatag

SEQ ID NO: 44205 - DNA, 15 bp, Homo sapiens
ccgggctcaaataga

SEQ ID NO: 44206 - DNA, 15 bp, Homo sapiens
cgggctcaaatagaa

SEQ ID NO: 44207 - DNA, 15 bp, Homo sapiens
gggctcaaatagaaa

SEQ ID NO: 44208 - DNA, 15 bp, Homo sapiens
ggctcaaatagaaat

SEQ ID NO: 44209 - DNA, 15 bp, Homo sapiens
gctcaaatagaaatc

SEQ ID NO: 44210 - DNA, 15 bp, Homo sapiens
ctcaaatagaaatct

SEQ ID NO: 44211 - DNA, 15 bp, Homo sapiens
tcaaatagaaatcta

SEQ ID NO: 44212 - DNA, 15 bp, Homo sapiens
caaatagaaatctag

SEQ ID NO: 44213 - DNA, 15 bp, Homo sapiens
aaatagaaatctagg

SEQ ID NO: 44214 - DNA, 15 bp, Homo sapiens
aatagaaatctaggt

SEQ ID NO: 44215 - DNA, 15 bp, Homo sapiens
atagaaatctaggtg

SEQ ID NO: 44216 - DNA, 15 bp, Homo sapiens
tagaaatctaggtgg

SEQ ID NO: 44217 - DNA, 15 bp, Homo sapiens
agaaatctaggtggg

SEQ ID NO: 44218 - DNA, 15 bp, Homo sapiens
gaaatctaggtgggt

SEQ ID NO: 44219 - DNA, 15 bp, Homo sapiens
aaatctaggtgggtc

SEQ ID NO: 44220 - DNA, 15 bp, Homo sapiens
aatctaggtgggtca

SEQ ID NO: 44221 - DNA, 15 bp, Homo sapiens
atctaggtgggtcag

SEQ ID NO: 44222 - DNA, 15 bp, Homo sapiens
tctaggtgggtcagt

SEQ ID NO: 44223 - DNA, 15 bp, Homo sapiens
ctaggtgggtcagta

SEQ ID NO: 44224 - DNA, 15 bp, Homo sapiens
taggtgggtcagtac

SEQ ID NO: 44225 - DNA, 15 bp, Homo sapiens
aggtgggtcagtaca

SEQ ID NO: 44226 - DNA, 15 bp, Homo sapiens
ggtgggtcagtacag

SEQ ID NO: 44227 - DNA, 15 bp, Homo sapiens
gtgggtcagtacaga

SEQ ID NO: 44228 - DNA, 15 bp, Homo sapiens
tgggtcagtacagag

SEQ ID NO: 44229 - DNA, 15 bp, Homo sapiens
gggtcagtacagagc

SEQ ID NO: 44230 - DNA, 15 bp, Homo sapiens
ggtcagtacagagct

SEQ ID NO: 44231 - DNA, 15 bp, Homo sapiens
gtcagtacagagctg

SEQ ID NO: 44232 - DNA, 15 bp, Homo sapiens
tcagtacagagctgc

SEQ ID NO: 44233 - DNA, 15 bp, Homo sapiens
cagtacagagctgcc

SEQ ID NO: 44234 - DNA, 15 bp, Homo sapiens
agtacagagctgcct

SEQ ID NO: 44235 - DNA, 15 bp, Homo sapiens
gtacagagctgcctg

SEQ ID NO: 44236 - DNA, 15 bp, Homo sapiens
tacagagctgcctga

SEQ ID NO: 44237 - DNA, 15 bp, Homo sapiens
acagagctgcctgac

SEQ ID NO: 44238 - DNA, 15 bp, Homo sapiens
cagagctgcctgaca

SEQ ID NO: 44239 - DNA, 15 bp, Homo sapiens
agagctgcctgacat

SEQ ID NO: 44240 - DNA, 15 bp, Homo sapiens
gagctgcctgacata

SEQ ID NO: 44241 - DNA, 15 bp, Homo sapiens
agctgcctgacataa

SEQ ID NO: 44242 - DNA, 15 bp, Homo sapiens
gctgcctgacataag

SEQ ID NO: 44243 - DNA, 15 bp, Homo sapiens
ctgcctgacataagt

SEQ ID NO: 44244 - DNA, 15 bp, Homo sapiens
tgcctgacataagta

SEQ ID NO: 44245 - DNA, 15 bp, Homo sapiens
gcctgacataagtaa

SEQ ID NO: 44246 - DNA, 15 bp, Homo sapiens
cctgacataagtaag

SEQ ID NO: 44247 - DNA, 15 bp, Homo sapiens
ctgacataagtaagt

SEQ ID NO: 44248 - DNA, 15 bp, Homo sapiens
tgacataagtaagta

SEQ ID NO: 44249 - DNA, 15 bp, Homo sapiens
gacataagtaagtag

SEQ ID NO: 44250 - DNA, 15 bp, Homo sapiens
acataagtaagtagc

SEQ ID NO: 44251 - DNA, 15 bp, Homo sapiens
cataagtaagtagca

SEQ ID NO: 44252 - DNA, 15 bp, Homo sapiens
ataagtaagtagcac

SEQ ID NO: 44253 - DNA, 15 bp, Homo sapiens
taagtaagtagcaca

SEQ ID NO: 44254 - DNA, 15 bp, Homo sapiens
aagtaagtagcacat

SEQ ID NO: 44255 - DNA, 15 bp, Homo sapiens
agtaagtagcacatg

SEQ ID NO: 44256 - DNA, 15 bp, Homo sapiens
gtaagtagcacatgg

SEQ ID NO: 44257 - DNA, 15 bp, Homo sapiens
taagtagcacatgga

SEQ ID NO: 44258 - DNA, 15 bp, Homo sapiens
aagtagcacatggag

SEQ ID NO: 44259 - DNA, 15 bp, Homo sapiens
agtagcacatggagc

SEQ ID NO: 44260 - DNA, 15 bp, Homo sapiens
gtagcacatggagca

SEQ ID NO: 44261 - DNA, 15 bp, Homo sapiens
tagcacatggagcat

SEQ ID NO: 44262 - DNA, 15 bp, Homo sapiens
agcacatggagcatt

SEQ ID NO: 44263 - DNA, 15 bp, Homo sapiens
gcacatggagcattg

SEQ ID NO: 44264 - DNA, 15 bp, Homo sapiens
cacatggagcattgc

SEQ ID NO: 44265 - DNA, 15 bp, Homo sapiens
acatggagcattgct

SEQ ID NO: 44266 - DNA, 15 bp, Homo sapiens
catggagcattgctt

SEQ ID NO: 44267 - DNA, 15 bp, Homo sapiens
atggagcattgcttg

SEQ ID NO: 44268 - DNA, 15 bp, Homo sapiens
tggagcattgcttgt

SEQ ID NO: 44269 - DNA, 15 bp, Homo sapiens
ggagcattgcttgtt

SEQ ID NO: 44270 - DNA, 15 bp, Homo sapiens
gagcattgcttgttg

SEQ ID NO: 44271 - DNA, 15 bp, Homo sapiens
agcattgcttgttgt

SEQ ID NO: 44272 - DNA, 15 bp, Homo sapiens
gcattgcttgttgtc

SEQ ID NO: 44273 - DNA, 15 bp, Homo sapiens
cattgcttgttgtca

SEQ ID NO: 44274 - DNA, 15 bp, Homo sapiens
attgcttgttgtcac

SEQ ID NO: 44275 - DNA, 15 bp, Homo sapiens
ttgcttgttgtcaca

SEQ ID NO: 44276 - DNA, 15 bp, Homo sapiens
tgcttgttgtcacag

SEQ ID NO: 44277 - DNA, 15 bp, Homo sapiens
gcttgttgtcacagt

SEQ ID NO: 44278 - DNA, 15 bp, Homo sapiens
cttgttgtcacagtt

SEQ ID NO: 44279 - DNA, 15 bp, Homo sapiens
ttgttgtcacagttg

SEQ ID NO: 44280 - DNA, 15 bp, Homo sapiens
tgttgtcacagttgt

SEQ ID NO: 44281 - DNA, 15 bp, Homo sapiens
gttgtcacagttgta

SEQ ID NO: 44282 - DNA, 15 bp, Homo sapiens
ttgtcacagttgtat

SEQ ID NO: 44283 - DNA, 15 bp, Homo sapiens
tgtcacagttgtatg

SEQ ID NO: 44284 - DNA, 15 bp, Homo sapiens
gtcacagttgtatgg

SEQ ID NO: 44285 - DNA, 15 bp, Homo sapiens
tcacagttgtatggc

SEQ ID NO: 44286 - DNA, 15 bp, Homo sapiens
cacagttgtatggct

SEQ ID NO: 44287 - DNA, 15 bp, Homo sapiens
acagttgtatggctg

SEQ ID NO: 44288 - DNA, 15 bp, Homo sapiens
cagttgtatggctgg

SEQ ID NO: 44289 - DNA, 15 bp, Homo sapiens
agttgtatggctggt

SEQ ID NO: 44290 - DNA, 15 bp, Homo sapiens
gttgtatggctggtt

SEQ ID NO: 44291 - DNA, 15 bp, Homo sapiens
ttgtatggctggttg

SEQ ID NO: 44292 - DNA, 15 bp, Homo sapiens
tgtatggctggttgc

SEQ ID NO: 44293 - DNA, 15 bp, Homo sapiens
gtatggctggttgct

SEQ ID NO: 44294 - DNA, 15 bp, Homo sapiens
tatggctggttgctt

SEQ ID NO: 44295 - DNA, 15 bp, Homo sapiens
atggctggttgcttg

SEQ ID NO: 44296 - DNA, 15 bp, Homo sapiens
tggctggttgcttga

SEQ ID NO: 44297 - DNA, 15 bp, Homo sapiens
ggctggttgcttgaa

SEQ ID NO: 44298 - DNA, 15 bp, Homo sapiens
gctggttgcttgaac

SEQ ID NO: 44299 - DNA, 15 bp, Homo sapiens
ctggttgcttgaaca

SEQ ID NO: 44300 - DNA, 15 bp, Homo sapiens
tggttgcttgaacag

SEQ ID NO: 44301 - DNA, 15 bp, Homo sapiens
ggttgcttgaacagt

SEQ ID NO: 44302 - DNA, 15 bp, Homo sapiens
gttgcttgaacagta

SEQ ID NO: 44303 - DNA, 15 bp, Homo sapiens
ttgcttgaacagtag

SEQ ID NO: 44304 - DNA, 15 bp, Homo sapiens
tgcttgaacagtagc

SEQ ID NO: 44305 - DNA, 15 bp, Homo sapiens
gcttgaacagtagcc

SEQ ID NO: 44306 - DNA, 15 bp, Homo sapiens
cttgaacagtagcca

SEQ ID NO: 44307 - DNA, 15 bp, Homo sapiens
ttgaacagtagccag

SEQ ID NO: 44308 - DNA, 15 bp, Homo sapiens
tgaacagtagccagt

SEQ ID NO: 44309 - DNA, 15 bp, Homo sapiens
gaacagtagccagtg

SEQ ID NO: 44310 - DNA, 15 bp, Homo sapiens
aacagtagccagtgg

SEQ ID NO: 44311 - DNA, 15 bp, Homo sapiens
acagtagccagtgga

SEQ ID NO: 44312 - DNA, 15 bp, Homo sapiens
cagtagccagtggaa

SEQ ID NO: 44313 - DNA, 15 bp, Homo sapiens
agtagccagtggaag

SEQ ID NO: 44314 - DNA, 15 bp, Homo sapiens
gtagccagtggaaga

SEQ ID NO: 44315 - DNA, 15 bp, Homo sapiens
tagccagtggaagac

SEQ ID NO: 44316 - DNA, 15 bp, Homo sapiens
agccagtggaagacc

SEQ ID NO: 44317 - DNA, 15 bp, Homo sapiens
gccagtggaagacct

SEQ ID NO: 44318 - DNA, 15 bp, Homo sapiens
ccagtggaagaccta

SEQ ID NO: 44319 - DNA, 15 bp, Homo sapiens
cagtggaagacctag

SEQ ID NO: 44320 - DNA, 15 bp, Homo sapiens
agtggaagacctagt

SEQ ID NO: 44321 - DNA, 15 bp, Homo sapiens
gtggaagacctagta

SEQ ID NO: 44322 - DNA, 15 bp, Homo sapiens
tggaagacctagtag

SEQ ID NO: 44323 - DNA, 15 bp, Homo sapiens
ggaagacctagtaga

SEQ ID NO: 44324 - DNA, 15 bp, Homo sapiens
gaagacctagtagaa

SEQ ID NO: 44325 - DNA, 15 bp, Homo sapiens
aagacctagtagaat

SEQ ID NO: 44326 - DNA, 15 bp, Homo sapiens
agacctagtagaatg

SEQ ID NO: 44327 - DNA, 15 bp, Homo sapiens
gacctagtagaatgt

SEQ ID NO: 44328 - DNA, 15 bp, Homo sapiens
acctagtagaatgtg

SEQ ID NO: 44329 - DNA, 15 bp, Homo sapiens
cctagtagaatgtgt

SEQ ID NO: 44330 - DNA, 15 bp, Homo sapiens
ctagtagaatgtgta

SEQ ID NO: 44331 - DNA, 15 bp, Homo sapiens
tagtagaatgtgtag

SEQ ID NO: 44332 - DNA, 15 bp, Homo sapiens
agtagaatgtgtaga

SEQ ID NO: 44333 - DNA, 15 bp, Homo sapiens
gtagaatgtgtagag

SEQ ID NO: 44334 - DNA, 15 bp, Homo sapiens
tagaatgtgtagaga

SEQ ID NO: 44335 - DNA, 15 bp, Homo sapiens
agaatgtgtagagaa

SEQ ID NO: 44336 - DNA, 15 bp, Homo sapiens
gaatgtgtagagaat

SEQ ID NO: 44337 - DNA, 15 bp, Homo sapiens
aatgtgtagagaatc

SEQ ID NO: 44338 - DNA, 15 bp, Homo sapiens
atgtgtagagaatct

SEQ ID NO: 44339 - DNA, 15 bp, Homo sapiens
tgtgtagagaatctg

SEQ ID NO: 44340 - DNA, 15 bp, Homo sapiens
gtgtagagaatctgg

SEQ ID NO: 44341 - DNA, 15 bp, Homo sapiens
tgtagagaatctggg

SEQ ID NO: 44342 - DNA, 15 bp, Homo sapiens
gtagagaatctgggt

SEQ ID NO: 44343 - DNA, 15 bp, Homo sapiens
tagagaatctgggtg

SEQ ID NO: 44344 - DNA, 15 bp, Homo sapiens
agagaatctgggtgc

SEQ ID NO: 44345 - DNA, 15 bp, Homo sapiens
gagaatctgggtgcc

SEQ ID NO: 44346 - DNA, 15 bp, Homo sapiens
agaatctgggtgccc

SEQ ID NO: 44347 - DNA, 15 bp, Homo sapiens
gaatctgggtgccct

SEQ ID NO: 44348 - DNA, 15 bp, Homo sapiens
aatctgggtgcccta

SEQ ID NO: 44349 - DNA, 15 bp, Homo sapiens
atctgggtgccctag

SEQ ID NO: 44350 - DNA, 15 bp, Homo sapiens
tctgggtgccctagt

SEQ ID NO: 44351 - DNA, 15 bp, Homo sapiens
ctgggtgccctagtc

SEQ ID NO: 44352 - DNA, 15 bp, Homo sapiens
tgggtgccctagtca

SEQ ID NO: 44353 - DNA, 15 bp, Homo sapiens
gggtgccctagtcaa

SEQ ID NO: 44354 - DNA, 15 bp, Homo sapiens
ggtgccctagtcaaa

SEQ ID NO: 44355 - DNA, 15 bp, Homo sapiens
gtgccctagtcaaaa

SEQ ID NO: 44356 - DNA, 15 bp, Homo sapiens
tgccctagtcaaaaa

SEQ ID NO: 44357 - DNA, 15 bp, Homo sapiens
gccctagtcaaaaac

SEQ ID NO: 44358 - DNA, 15 bp, Homo sapiens
ccctagtcaaaaacc

SEQ ID NO: 44359 - DNA, 15 bp, Homo sapiens
cctagtcaaaaacca

SEQ ID NO: 44360 - DNA, 15 bp, Homo sapiens
ctagtcaaaaaccag

SEQ ID NO: 44361 - DNA, 15 bp, Homo sapiens
tagtcaaaaaccagc

SEQ ID NO: 44362 - DNA, 15 bp, Homo sapiens
agtcaaaaaccagcg

SEQ ID NO: 44363 - DNA, 15 bp, Homo sapiens
gtcaaaaaccagcgt

SEQ ID NO: 44364 - DNA, 15 bp, Homo sapiens
tcaaaaaccagcgtc

SEQ ID NO: 44365 - DNA, 15 bp, Homo sapiens
caaaaaccagcgtcg

SEQ ID NO: 44366 - DNA, 15 bp, Homo sapiens
aaaaaccagcgtcgg

SEQ ID NO: 44367 - DNA, 15 bp, Homo sapiens
aaaaccagcgtcggt

SEQ ID NO: 44368 - DNA, 15 bp, Homo sapiens
aaaccagcgtcggta

SEQ ID NO: 44369 - DNA, 15 bp, Homo sapiens
aaccagcgtcggtat

SEQ ID NO: 44370 - DNA, 15 bp, Homo sapiens
accagcgtcggtatt

SEQ ID NO: 44371 - DNA, 15 bp, Homo sapiens
ccagcgtcggtattt

SEQ ID NO: 44372 - DNA, 15 bp, Homo sapiens
cagcgtcggtattta

SEQ ID NO: 44373 - DNA, 15 bp, Homo sapiens
agcgtcggtatttaa

SEQ ID NO: 44374 - DNA, 15 bp, Homo sapiens
gcgtcggtatttaag

SEQ ID NO: 44375 - DNA, 15 bp, Homo sapiens
cgtcggtatttaagt

SEQ ID NO: 44376 - DNA, 15 bp, Homo sapiens
gtcggtatttaagtt

SEQ ID NO: 44377 - DNA, 15 bp, Homo sapiens
tcggtatttaagttg

SEQ ID NO: 44378 - DNA, 15 bp, Homo sapiens
cggtatttaagttgg

SEQ ID NO: 44379 - DNA, 15 bp, Homo sapiens
ggtatttaagttggg

SEQ ID NO: 44380 - DNA, 15 bp, Homo sapiens
gtatttaagttggga

SEQ ID NO: 44381 - DNA, 15 bp, Homo sapiens
tatttaagttgggat

SEQ ID NO: 44382 - DNA, 15 bp, Homo sapiens
atttaagttgggatg

SEQ ID NO: 44383 - DNA, 15 bp, Homo sapiens
tttaagttgggatgt

SEQ ID NO: 44384 - DNA, 15 bp, Homo sapiens
ttaagttgggatgtg

SEQ ID NO: 44385 - DNA, 15 bp, Homo sapiens
taagttgggatgtgg

SEQ ID NO: 44386 - DNA, 15 bp, Homo sapiens
aagttgggatgtggt

SEQ ID NO: 44387 - DNA, 15 bp, Homo sapiens
agttgggatgtggta

SEQ ID NO: 44388 - DNA, 15 bp, Homo sapiens
gttgggatgtggtat

SEQ ID NO: 44389 - DNA, 15 bp, Homo sapiens
ttgggatgtggtatt

SEQ ID NO: 44390 - DNA, 15 bp, Homo sapiens
tgggatgtggtattc

SEQ ID NO: 44391 - DNA, 15 bp, Homo sapiens
gggatgtggtattca

SEQ ID NO: 44392 - DNA, 15 bp, Homo sapiens
ggatgtggtattcat

SEQ ID NO: 44393 - DNA, 15 bp, Homo sapiens
gatgtggtattcatc

SEQ ID NO: 44394 - DNA, 15 bp, Homo sapiens
atgtggtattcatct

SEQ ID NO: 44395 - DNA, 15 bp, Homo sapiens
tgtggtattcatctt

SEQ ID NO: 44396 - DNA, 15 bp, Homo sapiens
gtggtattcatcttg

SEQ ID NO: 44397 - DNA, 15 bp, Homo sapiens
tggtattcatcttgt

SEQ ID NO: 44398 - DNA, 15 bp, Homo sapiens
ggtattcatcttgtg

SEQ ID NO: 44399 - DNA, 15 bp, Homo sapiens
gtattcatcttgtga

SEQ ID NO: 44400 - DNA, 15 bp, Homo sapiens
tattcatcttgtgac

SEQ ID NO: 44401 - DNA, 15 bp, Homo sapiens
attcatcttgtgacc

SEQ ID NO: 44402 - DNA, 15 bp, Homo sapiens
ttcatcttgtgacca

SEQ ID NO: 44403 - DNA, 15 bp, Homo sapiens
tcatcttgtgaccag

SEQ ID NO: 44404 - DNA, 15 bp, Homo sapiens
catcttgtgaccagt

SEQ ID NO: 44405 - DNA, 15 bp, Homo sapiens
atcttgtgaccagtt

SEQ ID NO: 44406 - DNA, 15 bp, Homo sapiens
tcttgtgaccagttc

SEQ ID NO: 44407 - DNA, 15 bp, Homo sapiens
cttgtgaccagttct

SEQ ID NO: 44408 - DNA, 15 bp, Homo sapiens
ttgtgaccagttctc

SEQ ID NO: 44409 - DNA, 15 bp, Homo sapiens
tgtgaccagttctct

SEQ ID NO: 44410 - DNA, 15 bp, Homo sapiens
gtgaccagttctcta

SEQ ID NO: 44411 - DNA, 15 bp, Homo sapiens
tgaccagttctctac

SEQ ID NO: 44412 - DNA, 15 bp, Homo sapiens
gaccagttctctact

SEQ ID NO: 44413 - DNA, 15 bp, Homo sapiens
accagttctctactt

SEQ ID NO: 44414 - DNA, 15 bp, Homo sapiens
ccagttctctacttc

SEQ ID NO: 44415 - DNA, 15 bp, Homo sapiens
cagttctctacttct

SEQ ID NO: 44416 - DNA, 15 bp, Homo sapiens
agttctctacttctg

SEQ ID NO: 44417 - DNA, 15 bp, Homo sapiens
gttctctacttctgt

SEQ ID NO: 44418 - DNA, 15 bp, Homo sapiens
ttctctacttctgtc

SEQ ID NO: 44419 - DNA, 15 bp, Homo sapiens
tctctacttctgtcc

SEQ ID NO: 44420 - DNA, 15 bp, Homo sapiens
ctctacttctgtcct

SEQ ID NO: 44421 - DNA, 15 bp, Homo sapiens
tctacttctgtccta

SEQ ID NO: 44422 - DNA, 15 bp, Homo sapiens
ctacttctgtcctag

SEQ ID NO: 44423 - DNA, 15 bp, Homo sapiens
tacttctgtcctagg

SEQ ID NO: 44424 - DNA, 15 bp, Homo sapiens
acttctgtcctaggg

SEQ ID NO: 44425 - DNA, 15 bp, Homo sapiens
cttctgtcctagggt

SEQ ID NO: 44426 - DNA, 15 bp, Homo sapiens
ttctgtcctagggta

SEQ ID NO: 44427 - DNA, 15 bp, Homo sapiens
tctgtcctagggtac

SEQ ID NO: 44428 - DNA, 15 bp, Homo sapiens
ctgtcctagggtaca

SEQ ID NO: 44429 - DNA, 15 bp, Homo sapiens
tgtcctagggtacaa

SEQ ID NO: 44430 - DNA, 15 bp, Homo sapiens
gtcctagggtacaaa

SEQ ID NO: 44431 - DNA, 15 bp, Homo sapiens
tcctagggtacaaac

SEQ ID NO: 44432 - DNA, 15 bp, Homo sapiens
cctagggtacaaaca

SEQ ID NO: 44433 - DNA, 15 bp, Homo sapiens
ctagggtacaaacat

SEQ ID NO: 44434 - DNA, 15 bp, Homo sapiens
tagggtacaaacatt

SEQ ID NO: 44435 - DNA, 15 bp, Homo sapiens
agggtacaaacattg

SEQ ID NO: 44436 - DNA, 15 bp, Homo sapiens
gggtacaaacattgc

SEQ ID NO: 44437 - DNA, 15 bp, Homo sapiens
ggtacaaacattgct

SEQ ID NO: 44438 - DNA, 15 bp, Homo sapiens
gtacaaacattgctg

SEQ ID NO: 44439 - DNA, 15 bp, Homo sapiens
tacaaacattgctgc

SEQ ID NO: 44440 - DNA, 15 bp, Homo sapiens
acaaacattgctgct

SEQ ID NO: 44441 - DNA, 15 bp, Homo sapiens
caaacattgctgctg

SEQ ID NO: 44442 - DNA, 15 bp, Homo sapiens
aaacattgctgctgg

SEQ ID NO: 44443 - DNA, 15 bp, Homo sapiens
aacattgctgctggg

SEQ ID NO: 44444 - DNA, 15 bp, Homo sapiens
acattgctgctggga

SEQ ID NO: 44445 - DNA, 15 bp, Homo sapiens
cattgctgctgggaa

SEQ ID NO: 44446 - DNA, 15 bp, Homo sapiens
attgctgctgggaaa

SEQ ID NO: 44447 - DNA, 15 bp, Homo sapiens
ttgctgctgggaaag

SEQ ID NO: 44448 - DNA, 15 bp, Homo sapiens
tgctgctgggaaagc

SEQ ID NO: 44449 - DNA, 15 bp, Homo sapiens
gctgctgggaaagct

SEQ ID NO: 44450 - DNA, 15 bp, Homo sapiens
ctgctgggaaagcta

SEQ ID NO: 44451 - DNA, 15 bp, Homo sapiens
tgctgggaaagctat

SEQ ID NO: 44452 - DNA, 15 bp, Homo sapiens
gctgggaaagctatg

SEQ ID NO: 44453 - DNA, 15 bp, Homo sapiens
ctgggaaagctatgg

SEQ ID NO: 44454 - DNA, 15 bp, Homo sapiens
tgggaaagctatggg

SEQ ID NO: 44455 - DNA, 15 bp, Homo sapiens
gggaaagctatggga

SEQ ID NO: 44456 - DNA, 15 bp, Homo sapiens
ggaaagctatgggag

SEQ ID NO: 44457 - DNA, 15 bp, Homo sapiens
gaaagctatgggagt

SEQ ID NO: 44458 - DNA, 15 bp, Homo sapiens
aaagctatgggagtg

SEQ ID NO: 44459 - DNA, 15 bp, Homo sapiens
aagctatgggagtgg

SEQ ID NO: 44460 - DNA, 15 bp, Homo sapiens
agctatgggagtggt

SEQ ID NO: 44461 - DNA, 15 bp, Homo sapiens
gctatgggagtggtg

SEQ ID NO: 44462 - DNA, 15 bp, Homo sapiens
ctatgggagtggtgg

SEQ ID NO: 44463 - DNA, 15 bp, Homo sapiens
tatgggagtggtggt

SEQ ID NO: 44464 - DNA, 15 bp, Homo sapiens
atgggagtggtggta

SEQ ID NO: 44465 - DNA, 15 bp, Homo sapiens
tgggagtggtggtag

SEQ ID NO: 44466 - DNA, 15 bp, Homo sapiens
gggagtggtggtagc

SEQ ID NO: 44467 - DNA, 15 bp, Homo sapiens
ggagtggtggtagca

SEQ ID NO: 44468 - DNA, 15 bp, Homo sapiens
gagtggtggtagcaa

SEQ ID NO: 44469 - DNA, 15 bp, Homo sapiens
agtggtggtagcaac

SEQ ID NO: 44470 - DNA, 15 bp, Homo sapiens
gtggtggtagcaact

SEQ ID NO: 44471 - DNA, 15 bp, Homo sapiens
tggtggtagcaactg

SEQ ID NO: 44472 - DNA, 15 bp, Homo sapiens
ggtggtagcaactgg

SEQ ID NO: 44473 - DNA, 15 bp, Homo sapiens
gtggtagcaactgga

SEQ ID NO: 44474 - DNA, 15 bp, Homo sapiens
tggtagcaactggag

SEQ ID NO: 44475 - DNA, 15 bp, Homo sapiens
ggtagcaactggagt

SEQ ID NO: 44476 - DNA, 15 bp, Homo sapiens
gtagcaactggagtt

SEQ ID NO: 44477 - DNA, 15 bp, Homo sapiens
tagcaactggagtta

SEQ ID NO: 44478 - DNA, 15 bp, Homo sapiens
agcaactggagttaa

SEQ ID NO: 44479 - DNA, 15 bp, Homo sapiens
gcaactggagttaac

SEQ ID NO: 44480 - DNA, 15 bp, Homo sapiens
caactggagttaaca

SEQ ID NO: 44481 - DNA, 15 bp, Homo sapiens
aactggagttaacac

SEQ ID NO: 44482 - DNA, 15 bp, Homo sapiens
actggagttaacacc

SEQ ID NO: 44483 - DNA, 15 bp, Homo sapiens
ctggagttaacaccg

SEQ ID NO: 44484 - DNA, 15 bp, Homo sapiens
tggagttaacaccga

SEQ ID NO: 44485 - DNA, 15 bp, Homo sapiens
ggagttaacaccgaa

SEQ ID NO: 44486 - DNA, 15 bp, Homo sapiens
gagttaacaccgaaa

SEQ ID NO: 44487 - DNA, 15 bp, Homo sapiens
agttaacaccgaaat

SEQ ID NO: 44488 - DNA, 15 bp, Homo sapiens
gttaacaccgaaatt

SEQ ID NO: 44489 - DNA, 15 bp, Homo sapiens
ttaacaccgaaattg

SEQ ID NO: 44490 - DNA, 15 bp, Homo sapiens
taacaccgaaattgg

SEQ ID NO: 44491 - DNA, 15 bp, Homo sapiens
aacaccgaaattggc

SEQ ID NO: 44492 - DNA, 15 bp, Homo sapiens
acaccgaaattggca

SEQ ID NO: 44493 - DNA, 15 bp, Homo sapiens
caccgaaattggcaa

SEQ ID NO: 44494 - DNA, 15 bp, Homo sapiens
accgaaattggcaag

SEQ ID NO: 44495 - DNA, 15 bp, Homo sapiens
ccgaaattggcaaga

SEQ ID NO: 44496 - DNA, 15 bp, Homo sapiens
cgaaattggcaagat

SEQ ID NO: 44497 - DNA, 15 bp, Homo sapiens
gaaattggcaagatc

SEQ ID NO: 44498 - DNA, 15 bp, Homo sapiens
aaattggcaagatcc

SEQ ID NO: 44499 - DNA, 15 bp, Homo sapiens
aattggcaagatccg

SEQ ID NO: 44500 - DNA, 15 bp, Homo sapiens
attggcaagatccgg

SEQ ID NO: 44501 - DNA, 15 bp, Homo sapiens
ttggcaagatccggg

SEQ ID NO: 44502 - DNA, 15 bp, Homo sapiens
tggcaagatccggga

SEQ ID NO: 44503 - DNA, 15 bp, Homo sapiens
ggcaagatccgggat

SEQ ID NO: 44504 - DNA, 15 bp, Homo sapiens
gcaagatccgggatg

SEQ ID NO: 44505 - DNA, 15 bp, Homo sapiens
caagatccgggatga

SEQ ID NO: 44506 - DNA, 15 bp, Homo sapiens
aagatccgggatgaa

SEQ ID NO: 44507 - DNA, 15 bp, Homo sapiens
agatccgggatgaaa

SEQ ID NO: 44508 - DNA, 15 bp, Homo sapiens
gatccgggatgaaat

SEQ ID NO: 44509 - DNA, 15 bp, Homo sapiens
atccgggatgaaatg

SEQ ID NO: 44510 - DNA, 15 bp, Homo sapiens
tccgggatgaaatgg

SEQ ID NO: 44511 - DNA, 15 bp, Homo sapiens
ccgggatgaaatggt

SEQ ID NO: 44512 - DNA, 15 bp, Homo sapiens
cgggatgaaatggtg

SEQ ID NO: 44513 - DNA, 15 bp, Homo sapiens
gggatgaaatggtgg

SEQ ID NO: 44514 - DNA, 15 bp, Homo sapiens
ggatgaaatggtggc

SEQ ID NO: 44515 - DNA, 15 bp, Homo sapiens
gatgaaatggtggca

SEQ ID NO: 44516 - DNA, 15 bp, Homo sapiens
atgaaatggtggcaa

SEQ ID NO: 44517 - DNA, 15 bp, Homo sapiens
tgaaatggtggcaac

SEQ ID NO: 44518 - DNA, 15 bp, Homo sapiens
gaaatggtggcaaca

SEQ ID NO: 44519 - DNA, 15 bp, Homo sapiens
aaatggtggcaacag

SEQ ID NO: 44520 - DNA, 15 bp, Homo sapiens
aatggtggcaacaga

SEQ ID NO: 44521 - DNA, 15 bp, Homo sapiens
atggtggcaacagaa

SEQ ID NO: 44522 - DNA, 15 bp, Homo sapiens
tggtggcaacagaac

SEQ ID NO: 44523 - DNA, 15 bp, Homo sapiens
ggtggcaacagaaca

SEQ ID NO: 44524 - DNA, 15 bp, Homo sapiens
gtggcaacagaacag

SEQ ID NO: 44525 - DNA, 15 bp, Homo sapiens
tggcaacagaacagg

SEQ ID NO: 44526 - DNA, 15 bp, Homo sapiens
ggcaacagaacagga

SEQ ID NO: 44527 - DNA, 15 bp, Homo sapiens
gcaacagaacaggag

SEQ ID NO: 44528 - DNA, 15 bp, Homo sapiens
caacagaacaggaga

SEQ ID NO: 44529 - DNA, 15 bp, Homo sapiens
aacagaacaggagag

SEQ ID NO: 44530 - DNA, 15 bp, Homo sapiens
acagaacaggagaga

SEQ ID NO: 44531 - DNA, 15 bp, Homo sapiens
cagaacaggagagaa

SEQ ID NO: 44532 - DNA, 15 bp, Homo sapiens
agaacaggagagaac

SEQ ID NO: 44533 - DNA, 15 bp, Homo sapiens
gaacaggagagaaca

SEQ ID NO: 44534 - DNA, 15 bp, Homo sapiens
aacaggagagaacac

SEQ ID NO: 44535 - DNA, 15 bp, Homo sapiens
acaggagagaacacc

SEQ ID NO: 44536 - DNA, 15 bp, Homo sapiens
caggagagaacaccc

SEQ ID NO: 44537 - DNA, 15 bp, Homo sapiens
aggagagaacacccc

SEQ ID NO: 44538 - DNA, 15 bp, Homo sapiens
ggagagaacacccct

SEQ ID NO: 44539 - DNA, 15 bp, Homo sapiens
gagagaacacccctt

SEQ ID NO: 44540 - DNA, 15 bp, Homo sapiens
agagaacaccccttc

SEQ ID NO: 44541 - DNA, 15 bp, Homo sapiens
gagaacaccccttca

SEQ ID NO: 44542 - DNA, 15 bp, Homo sapiens
agaacaccccttcag

SEQ ID NO: 44543 - DNA, 15 bp, Homo sapiens
gaacaccccttcagc

SEQ ID NO: 44544 - DNA, 15 bp, Homo sapiens
aacaccccttcagca

SEQ ID NO: 44545 - DNA, 15 bp, Homo sapiens
acaccccttcagcaa

SEQ ID NO: 44546 - DNA, 15 bp, Homo sapiens
caccccttcagcaaa

SEQ ID NO: 44547 - DNA, 15 bp, Homo sapiens
accccttcagcaaaa

SEQ ID NO: 44548 - DNA, 15 bp, Homo sapiens
ccccttcagcaaaaa

SEQ ID NO: 44549 - DNA, 15 bp, Homo sapiens
cccttcagcaaaaac

SEQ ID NO: 44550 - DNA, 15 bp, Homo sapiens
ccttcagcaaaaact

SEQ ID NO: 44551 - DNA, 15 bp, Homo sapiens
cttcagcaaaaacta

SEQ ID NO: 44552 - DNA, 15 bp, Homo sapiens
ttcagcaaaaactag

SEQ ID NO: 44553 - DNA, 15 bp, Homo sapiens
tcagcaaaaactaga

SEQ ID NO: 44554 - DNA, 15 bp, Homo sapiens
cagcaaaaactagat

SEQ ID NO: 44555 - DNA, 15 bp, Homo sapiens
agcaaaaactagatg

SEQ ID NO: 44556 - DNA, 15 bp, Homo sapiens
gcaaaaactagatga

SEQ ID NO: 44557 - DNA, 15 bp, Homo sapiens
caaaaactagatgaa

SEQ ID NO: 44558 - DNA, 15 bp, Homo sapiens
aaaaactagatgaat

SEQ ID NO: 44559 - DNA, 15 bp, Homo sapiens
aaaactagatgaatt

SEQ ID NO: 44560 - DNA, 15 bp, Homo sapiens
aaactagatgaattt

SEQ ID NO: 44561 - DNA, 15 bp, Homo sapiens
aactagatgaatttg

SEQ ID NO: 44562 - DNA, 15 bp, Homo sapiens
actagatgaatttgg

SEQ ID NO: 44563 - DNA, 15 bp, Homo sapiens
ctagatgaatttggg

SEQ ID NO: 44564 - DNA, 15 bp, Homo sapiens
tagatgaatttgggg

SEQ ID NO: 44565 - DNA, 15 bp, Homo sapiens
agatgaatttgggga

SEQ ID NO: 44566 - DNA, 15 bp, Homo sapiens
gatgaatttggggaa

SEQ ID NO: 44567 - DNA, 15 bp, Homo sapiens
atgaatttggggaac

SEQ ID NO: 44568 - DNA, 15 bp, Homo sapiens
tgaatttggggaaca

SEQ ID NO: 44569 - DNA, 15 bp, Homo sapiens
gaatttggggaacag

SEQ ID NO: 44570 - DNA, 15 bp, Homo sapiens
aatttggggaacagc

SEQ ID NO: 44571 - DNA, 15 bp, Homo sapiens
atttggggaacagct

SEQ ID NO: 44572 - DNA, 15 bp, Homo sapiens
tttggggaacagctt

SEQ ID NO: 44573 - DNA, 15 bp, Homo sapiens
ttggggaacagcttt

SEQ ID NO: 44574 - DNA, 15 bp, Homo sapiens
tggggaacagctttc

SEQ ID NO: 44575 - DNA, 15 bp, Homo sapiens
ggggaacagctttcc

SEQ ID NO: 44576 - DNA, 15 bp, Homo sapiens
gggaacagctttcca

SEQ ID NO: 44577 - DNA, 15 bp, Homo sapiens
ggaacagctttccaa

SEQ ID NO: 44578 - DNA, 15 bp, Homo sapiens
gaacagctttccaaa

SEQ ID NO: 44579 - DNA, 15 bp, Homo sapiens
aacagctttccaaag

SEQ ID NO: 44580 - DNA, 15 bp, Homo sapiens
acagctttccaaagt

SEQ ID NO: 44581 - DNA, 15 bp, Homo sapiens
cagctttccaaagtc

SEQ ID NO: 44582 - DNA, 15 bp, Homo sapiens
agctttccaaagtca

SEQ ID NO: 44583 - DNA, 15 bp, Homo sapiens
gctttccaaagtcat

SEQ ID NO: 44584 - DNA, 15 bp, Homo sapiens
ctttccaaagtcatc

SEQ ID NO: 44585 - DNA, 15 bp, Homo sapiens
tttccaaagtcatct

SEQ ID NO: 44586 - DNA, 15 bp, Homo sapiens
ttccaaagtcatctc

SEQ ID NO: 44587 - DNA, 15 bp, Homo sapiens
tccaaagtcatctcc

SEQ ID NO: 44588 - DNA, 15 bp, Homo sapiens
ccaaagtcatctccc

SEQ ID NO: 44589 - DNA, 15 bp, Homo sapiens
caaagtcatctccct

SEQ ID NO: 44590 - DNA, 15 bp, Homo sapiens
aaagtcatctccctt

SEQ ID NO: 44591 - DNA, 15 bp, Homo sapiens
aagtcatctccctta

SEQ ID NO: 44592 - DNA, 15 bp, Homo sapiens
agtcatctcccttat

SEQ ID NO: 44593 - DNA, 15 bp, Homo sapiens
gtcatctcccttatt

SEQ ID NO: 44594 - DNA, 15 bp, Homo sapiens
tcatctcccttattt

SEQ ID NO: 44595 - DNA, 15 bp, Homo sapiens
catctcccttatttg

SEQ ID NO: 44596 - DNA, 15 bp, Homo sapiens
atctcccttatttgc

SEQ ID NO: 44597 - DNA, 15 bp, Homo sapiens
tctcccttatttgca

SEQ ID NO: 44598 - DNA, 15 bp, Homo sapiens
ctcccttatttgcat

SEQ ID NO: 44599 - DNA, 15 bp, Homo sapiens
tcccttatttgcatt

SEQ ID NO: 44600 - DNA, 15 bp, Homo sapiens
cccttatttgcattg

SEQ ID NO: 44601 - DNA, 15 bp, Homo sapiens
ccttatttgcattgc

SEQ ID NO: 44602 - DNA, 15 bp, Homo sapiens
cttatttgcattgca

SEQ ID NO: 44603 - DNA, 15 bp, Homo sapiens
ttatttgcattgcag

SEQ ID NO: 44604 - DNA, 15 bp, Homo sapiens
tatttgcattgcagt

SEQ ID NO: 44605 - DNA, 15 bp, Homo sapiens
atttgcattgcagtc

SEQ ID NO: 44606 - DNA, 15 bp, Homo sapiens
tttgcattgcagtct

SEQ ID NO: 44607 - DNA, 15 bp, Homo sapiens
ttgcattgcagtctg

SEQ ID NO: 44608 - DNA, 15 bp, Homo sapiens
tgcattgcagtctgg

SEQ ID NO: 44609 - DNA, 15 bp, Homo sapiens
gcattgcagtctgga

SEQ ID NO: 44610 - DNA, 15 bp, Homo sapiens
cattgcagtctggat

SEQ ID NO: 44611 - DNA, 15 bp, Homo sapiens
attgcagtctggatc

SEQ ID NO: 44612 - DNA, 15 bp, Homo sapiens
ttgcagtctggatca

SEQ ID NO: 44613 - DNA, 15 bp, Homo sapiens
tgcagtctggatcat

SEQ ID NO: 44614 - DNA, 15 bp, Homo sapiens
gcagtctggatcata

SEQ ID NO: 44615 - DNA, 15 bp, Homo sapiens
cagtctggatcataa

SEQ ID NO: 44616 - DNA, 15 bp, Homo sapiens
agtctggatcataaa

SEQ ID NO: 44617 - DNA, 15 bp, Homo sapiens
gtctggatcataaat

SEQ ID NO: 44618 - DNA, 15 bp, Homo sapiens
tctggatcataaata

SEQ ID NO: 44619 - DNA, 15 bp, Homo sapiens
ctggatcataaatat

SEQ ID NO: 44620 - DNA, 15 bp, Homo sapiens
tggatcataaatatt

SEQ ID NO: 44621 - DNA, 15 bp, Homo sapiens
ggatcataaatattg

SEQ ID NO: 44622 - DNA, 15 bp, Homo sapiens
gatcataaatattgg

SEQ ID NO: 44623 - DNA, 15 bp, Homo sapiens
atcataaatattggg

SEQ ID NO: 44624 - DNA, 15 bp, Homo sapiens
tcataaatattgggc

SEQ ID NO: 44625 - DNA, 15 bp, Homo sapiens
cataaatattgggca

SEQ ID NO: 44626 - DNA, 15 bp, Homo sapiens
ataaatattgggcac

SEQ ID NO: 44627 - DNA, 15 bp, Homo sapiens
taaatattgggcact

SEQ ID NO: 44628 - DNA, 15 bp, Homo sapiens
aaatattgggcactt

SEQ ID NO: 44629 - DNA, 15 bp, Homo sapiens
aatattgggcacttc

SEQ ID NO: 44630 - DNA, 15 bp, Homo sapiens
atattgggcacttca

SEQ ID NO: 44631 - DNA, 15 bp, Homo sapiens
tattgggcacttcaa

SEQ ID NO: 44632 - DNA, 15 bp, Homo sapiens
attgggcacttcaat

SEQ ID NO: 44633 - DNA, 15 bp, Homo sapiens
ttgggcacttcaatg

SEQ ID NO: 44634 - DNA, 15 bp, Homo sapiens
tgggcacttcaatga

SEQ ID NO: 44635 - DNA, 15 bp, Homo sapiens
gggcacttcaatgac

SEQ ID NO: 44636 - DNA, 15 bp, Homo sapiens
ggcacttcaatgacc

SEQ ID NO: 44637 - DNA, 15 bp, Homo sapiens
gcacttcaatgaccc

SEQ ID NO: 44638 - DNA, 15 bp, Homo sapiens
cacttcaatgacccg

SEQ ID NO: 44639 - DNA, 15 bp, Homo sapiens
acttcaatgacccgg

SEQ ID NO: 44640 - DNA, 15 bp, Homo sapiens
cttcaatgacccggt

SEQ ID NO: 44641 - DNA, 15 bp, Homo sapiens
ttcaatgacccggtt

SEQ ID NO: 44642 - DNA, 15 bp, Homo sapiens
tcaatgacccggttc

SEQ ID NO: 44643 - DNA, 15 bp, Homo sapiens
caatgacccggttca

SEQ ID NO: 44644 - DNA, 15 bp, Homo sapiens
aatgacccggttcat

SEQ ID NO: 44645 - DNA, 15 bp, Homo sapiens
atgacccggttcatg

SEQ ID NO: 44646 - DNA, 15 bp, Homo sapiens
tgacccggttcatgg

SEQ ID NO: 44647 - DNA, 15 bp, Homo sapiens
gacccggttcatgga

SEQ ID NO: 44648 - DNA, 15 bp, Homo sapiens
acccggttcatggag

SEQ ID NO: 44649 - DNA, 15 bp, Homo sapiens
cccggttcatggagg

SEQ ID NO: 44650 - DNA, 15 bp, Homo sapiens
ccggttcatggaggg

SEQ ID NO: 44651 - DNA, 15 bp, Homo sapiens
cggttcatggagggt

SEQ ID NO: 44652 - DNA, 15 bp, Homo sapiens
ggttcatggagggtc

SEQ ID NO: 44653 - DNA, 15 bp, Homo sapiens
gttcatggagggtcc

SEQ ID NO: 44654 - DNA, 15 bp, Homo sapiens
ttcatggagggtcct

SEQ ID NO: 44655 - DNA, 15 bp, Homo sapiens
tcatggagggtcctg

SEQ ID NO: 44656 - DNA, 15 bp, Homo sapiens
catggagggtcctgg

SEQ ID NO: 44657 - DNA, 15 bp, Homo sapiens
atggagggtcctgga

SEQ ID NO: 44658 - DNA, 15 bp, Homo sapiens
tggagggtcctggat

SEQ ID NO: 44659 - DNA, 15 bp, Homo sapiens
ggagggtcctggatc

SEQ ID NO: 44660 - DNA, 15 bp, Homo sapiens
gagggtcctggatca

SEQ ID NO: 44661 - DNA, 15 bp, Homo sapiens
agggtcctggatcag

SEQ ID NO: 44662 - DNA, 15 bp, Homo sapiens
gggtcctggatcaga

SEQ ID NO: 44663 - DNA, 15 bp, Homo sapiens
ggtcctggatcagag

SEQ ID NO: 44664 - DNA, 15 bp, Homo sapiens
gtcctggatcagagg

SEQ ID NO: 44665 - DNA, 15 bp, Homo sapiens
tcctggatcagaggt

SEQ ID NO: 44666 - DNA, 15 bp, Homo sapiens
cctggatcagaggtg

SEQ ID NO: 44667 - DNA, 15 bp, Homo sapiens
ctggatcagaggtgc

SEQ ID NO: 44668 - DNA, 15 bp, Homo sapiens
tggatcagaggtgct

SEQ ID NO: 44669 - DNA, 15 bp, Homo sapiens
ggatcagaggtgcta

SEQ ID NO: 44670 - DNA, 15 bp, Homo sapiens
gatcagaggtgctat

SEQ ID NO: 44671 - DNA, 15 bp, Homo sapiens
atcagaggtgctatt

SEQ ID NO: 44672 - DNA, 15 bp, Homo sapiens
tcagaggtgctattt

SEQ ID NO: 44673 - DNA, 15 bp, Homo sapiens
cagaggtgctattta

SEQ ID NO: 44674 - DNA, 15 bp, Homo sapiens
agaggtgctatttac

SEQ ID NO: 44675 - DNA, 15 bp, Homo sapiens
gaggtgctatttact

SEQ ID NO: 44676 - DNA, 15 bp, Homo sapiens
aggtgctatttacta

SEQ ID NO: 44677 - DNA, 15 bp, Homo sapiens
ggtgctatttactac

SEQ ID NO: 44678 - DNA, 15 bp, Homo sapiens
gtgctatttactact

SEQ ID NO: 44679 - DNA, 15 bp, Homo sapiens
tgctatttactactt

SEQ ID NO: 44680 - DNA, 15 bp, Homo sapiens
gctatttactacttt

SEQ ID NO: 44681 - DNA, 15 bp, Homo sapiens
ctatttactacttta

SEQ ID NO: 44682 - DNA, 15 bp, Homo sapiens
tatttactactttaa

SEQ ID NO: 44683 - DNA, 15 bp, Homo sapiens
atttactactttaaa

SEQ ID NO: 44684 - DNA, 15 bp, Homo sapiens
tttactactttaaaa

SEQ ID NO: 44685 - DNA, 15 bp, Homo sapiens
ttactactttaaaat

SEQ ID NO: 44686 - DNA, 15 bp, Homo sapiens
tactactttaaaatt

SEQ ID NO: 44687 - DNA, 15 bp, Homo sapiens
actactttaaaattg

SEQ ID NO: 44688 - DNA, 15 bp, Homo sapiens
ctactttaaaattgc

SEQ ID NO: 44689 - DNA, 15 bp, Homo sapiens
tactttaaaattgca

SEQ ID NO: 44690 - DNA, 15 bp, Homo sapiens
actttaaaattgcag

SEQ ID NO: 44691 - DNA, 15 bp, Homo sapiens
ctttaaaattgcagt

SEQ ID NO: 44692 - DNA, 15 bp, Homo sapiens
tttaaaattgcagtg

SEQ ID NO: 44693 - DNA, 15 bp, Homo sapiens
ttaaaattgcagtgg

SEQ ID NO: 44694 - DNA, 15 bp, Homo sapiens
taaaattgcagtggc

SEQ ID NO: 44695 - DNA, 15 bp, Homo sapiens
aaaattgcagtggcc

SEQ ID NO: 44696 - DNA, 15 bp, Homo sapiens
aaattgcagtggccc

SEQ ID NO: 44697 - DNA, 15 bp, Homo sapiens
aattgcagtggccct

SEQ ID NO: 44698 - DNA, 15 bp, Homo sapiens
attgcagtggccctg

SEQ ID NO: 44699 - DNA, 15 bp, Homo sapiens
ttgcagtggccctgg

SEQ ID NO: 44700 - DNA, 15 bp, Homo sapiens
tgcagtggccctggc

SEQ ID NO: 44701 - DNA, 15 bp, Homo sapiens
gcagtggccctggct

SEQ ID NO: 44702 - DNA, 15 bp, Homo sapiens
cagtggccctggctg

SEQ ID NO: 44703 - DNA, 15 bp, Homo sapiens
agtggccctggctgt

SEQ ID NO: 44704 - DNA, 15 bp, Homo sapiens
gtggccctggctgta

SEQ ID NO: 44705 - DNA, 15 bp, Homo sapiens
tggccctggctgtag

SEQ ID NO: 44706 - DNA, 15 bp, Homo sapiens
ggccctggctgtagc

SEQ ID NO: 44707 - DNA, 15 bp, Homo sapiens
gccctggctgtagca

SEQ ID NO: 44708 - DNA, 15 bp, Homo sapiens
ccctggctgtagcag

SEQ ID NO: 44709 - DNA, 15 bp, Homo sapiens
cctggctgtagcagc

SEQ ID NO: 44710 - DNA, 15 bp, Homo sapiens
ctggctgtagcagcc

SEQ ID NO: 44711 - DNA, 15 bp, Homo sapiens
tggctgtagcagcca

SEQ ID NO: 44712 - DNA, 15 bp, Homo sapiens
ggctgtagcagccat

SEQ ID NO: 44713 - DNA, 15 bp, Homo sapiens
gctgtagcagccatt

SEQ ID NO: 44714 - DNA, 15 bp, Homo sapiens
ctgtagcagccattc

SEQ ID NO: 44715 - DNA, 15 bp, Homo sapiens
tgtagcagccattcc

SEQ ID NO: 44716 - DNA, 15 bp, Homo sapiens
gtagcagccattcct

SEQ ID NO: 44717 - DNA, 15 bp, Homo sapiens
tagcagccattcctg

SEQ ID NO: 44718 - DNA, 15 bp, Homo sapiens
agcagccattcctga

SEQ ID NO: 44719 - DNA, 15 bp, Homo sapiens
gcagccattcctgaa

SEQ ID NO: 44720 - DNA, 15 bp, Homo sapiens
cagccattcctgaag

SEQ ID NO: 44721 - DNA, 15 bp, Homo sapiens
agccattcctgaagg

SEQ ID NO: 44722 - DNA, 15 bp, Homo sapiens
gccattcctgaaggt

SEQ ID NO: 44723 - DNA, 15 bp, Homo sapiens
ccattcctgaaggtc

SEQ ID NO: 44724 - DNA, 15 bp, Homo sapiens
cattcctgaaggtct

SEQ ID NO: 44725 - DNA, 15 bp, Homo sapiens
attcctgaaggtctg

SEQ ID NO: 44726 - DNA, 15 bp, Homo sapiens
ttcctgaaggtctgc

SEQ ID NO: 44727 - DNA, 15 bp, Homo sapiens
tcctgaaggtctgcc

SEQ ID NO: 44728 - DNA, 15 bp, Homo sapiens
cctgaaggtctgcct

SEQ ID NO: 44729 - DNA, 15 bp, Homo sapiens
ctgaaggtctgcctg

SEQ ID NO: 44730 - DNA, 15 bp, Homo sapiens
tgaaggtctgcctgc

SEQ ID NO: 44731 - DNA, 15 bp, Homo sapiens
gaaggtctgcctgca

SEQ ID NO: 44732 - DNA, 15 bp, Homo sapiens
aaggtctgcctgcag

SEQ ID NO: 44733 - DNA, 15 bp, Homo sapiens
aggtctgcctgcagt

SEQ ID NO: 44734 - DNA, 15 bp, Homo sapiens
ggtctgcctgcagtc

SEQ ID NO: 44735 - DNA, 15 bp, Homo sapiens
gtctgcctgcagtca

SEQ ID NO: 44736 - DNA, 15 bp, Homo sapiens
tctgcctgcagtcat

SEQ ID NO: 44737 - DNA, 15 bp, Homo sapiens
ctgcctgcagtcatc

SEQ ID NO: 44738 - DNA, 15 bp, Homo sapiens
tgcctgcagtcatca

SEQ ID NO: 44739 - DNA, 15 bp, Homo sapiens
gcctgcagtcatcac

SEQ ID NO: 44740 - DNA, 15 bp, Homo sapiens
cctgcagtcatcacc

SEQ ID NO: 44741 - DNA, 15 bp, Homo sapiens
ctgcagtcatcacca

SEQ ID NO: 44742 - DNA, 15 bp, Homo sapiens
tgcagtcatcaccac

SEQ ID NO: 44743 - DNA, 15 bp, Homo sapiens
gcagtcatcaccacc

SEQ ID NO: 44744 - DNA, 15 bp, Homo sapiens
cagtcatcaccacct

SEQ ID NO: 44745 - DNA, 15 bp, Homo sapiens
agtcatcaccacctg

SEQ ID NO: 44746 - DNA, 15 bp, Homo sapiens
gtcatcaccacctgc

SEQ ID NO: 44747 - DNA, 15 bp, Homo sapiens
tcatcaccacctgcc

SEQ ID NO: 44748 - DNA, 15 bp, Homo sapiens
catcaccacctgcct

SEQ ID NO: 44749 - DNA, 15 bp, Homo sapiens
atcaccacctgcctg

SEQ ID NO: 44750 - DNA, 15 bp, Homo sapiens
tcaccacctgcctgg

SEQ ID NO: 44751 - DNA, 15 bp, Homo sapiens
caccacctgcctggc

SEQ ID NO: 44752 - DNA, 15 bp, Homo sapiens
accacctgcctggct

SEQ ID NO: 44753 - DNA, 15 bp, Homo sapiens
ccacctgcctggctc

SEQ ID NO: 44754 - DNA, 15 bp, Homo sapiens
cacctgcctggctct

SEQ ID NO: 44755 - DNA, 15 bp, Homo sapiens
acctgcctggctctt

SEQ ID NO: 44756 - DNA, 15 bp, Homo sapiens
cctgcctggctcttg

SEQ ID NO: 44757 - DNA, 15 bp, Homo sapiens
ctgcctggctcttgg

SEQ ID NO: 44758 - DNA, 15 bp, Homo sapiens
tgcctggctcttgga

SEQ ID NO: 44759 - DNA, 15 bp, Homo sapiens
gcctggctcttggaa

SEQ ID NO: 44760 - DNA, 15 bp, Homo sapiens
cctggctcttggaac

SEQ ID NO: 44761 - DNA, 15 bp, Homo sapiens
ctggctcttggaact

SEQ ID NO: 44762 - DNA, 15 bp, Homo sapiens
tggctcttggaactc

SEQ ID NO: 44763 - DNA, 15 bp, Homo sapiens
ggctcttggaactcg

SEQ ID NO: 44764 - DNA, 15 bp, Homo sapiens
gctcttggaactcgc

SEQ ID NO: 44765 - DNA, 15 bp, Homo sapiens
ctcttggaactcgca

SEQ ID NO: 44766 - DNA, 15 bp, Homo sapiens
tcttggaactcgcag

SEQ ID NO: 44767 - DNA, 15 bp, Homo sapiens
cttggaactcgcaga

SEQ ID NO: 44768 - DNA, 15 bp, Homo sapiens
ttggaactcgcagaa

SEQ ID NO: 44769 - DNA, 15 bp, Homo sapiens
tggaactcgcagaat

SEQ ID NO: 44770 - DNA, 15 bp, Homo sapiens
ggaactcgcagaatg

SEQ ID NO: 44771 - DNA, 15 bp, Homo sapiens
gaactcgcagaatgg

SEQ ID NO: 44772 - DNA, 15 bp, Homo sapiens
aactcgcagaatggc

SEQ ID NO: 44773 - DNA, 15 bp, Homo sapiens
actcgcagaatggca

SEQ ID NO: 44774 - DNA, 15 bp, Homo sapiens
ctcgcagaatggcaa

SEQ ID NO: 44775 - DNA, 15 bp, Homo sapiens
tcgcagaatggcaaa

SEQ ID NO: 44776 - DNA, 15 bp, Homo sapiens
cgcagaatggcaaag

SEQ ID NO: 44777 - DNA, 15 bp, Homo sapiens
gcagaatggcaaaga

SEQ ID NO: 44778 - DNA, 15 bp, Homo sapiens
cagaatggcaaagaa

SEQ ID NO: 44779 - DNA, 15 bp, Homo sapiens
agaatggcaaagaaa

SEQ ID NO: 44780 - DNA, 15 bp, Homo sapiens
gaatggcaaagaaaa

SEQ ID NO: 44781 - DNA, 15 bp, Homo sapiens
aatggcaaagaaaaa

SEQ ID NO: 44782 - DNA, 15 bp, Homo sapiens
atggcaaagaaaaat

SEQ ID NO: 44783 - DNA, 15 bp, Homo sapiens
tggcaaagaaaaatg

SEQ ID NO: 44784 - DNA, 15 bp, Homo sapiens
ggcaaagaaaaatgc

SEQ ID NO: 44785 - DNA, 15 bp, Homo sapiens
gcaaagaaaaatgcc

SEQ ID NO: 44786 - DNA, 15 bp, Homo sapiens
caaagaaaaatgcca

SEQ ID NO: 44787 - DNA, 15 bp, Homo sapiens
aaagaaaaatgccat

SEQ ID NO: 44788 - DNA, 15 bp, Homo sapiens
aagaaaaatgccatt

SEQ ID NO: 44789 - DNA, 15 bp, Homo sapiens
agaaaaatgccattg

SEQ ID NO: 44790 - DNA, 15 bp, Homo sapiens
gaaaaatgccattgt

SEQ ID NO: 44791 - DNA, 15 bp, Homo sapiens
aaaaatgccattgtt

SEQ ID NO: 44792 - DNA, 15 bp, Homo sapiens
aaaatgccattgttc

SEQ ID NO: 44793 - DNA, 15 bp, Homo sapiens
aaatgccattgttcg

SEQ ID NO: 44794 - DNA, 15 bp, Homo sapiens
aatgccattgttcga

SEQ ID NO: 44795 - DNA, 15 bp, Homo sapiens
atgccattgttcgaa

SEQ ID NO: 44796 - DNA, 15 bp, Homo sapiens
tgccattgttcgaag

SEQ ID NO: 44797 - DNA, 15 bp, Homo sapiens
gccattgttcgaagc

SEQ ID NO: 44798 - DNA, 15 bp, Homo sapiens
ccattgttcgaagcc

SEQ ID NO: 44799 - DNA, 15 bp, Homo sapiens
cattgttcgaagcct

SEQ ID NO: 44800 - DNA, 15 bp, Homo sapiens
attgttcgaagcctc

SEQ ID NO: 44801 - DNA, 15 bp, Homo sapiens
ttgttcgaagcctcc

SEQ ID NO: 44802 - DNA, 15 bp, Homo sapiens
tgttcgaagcctccc

SEQ ID NO: 44803 - DNA, 15 bp, Homo sapiens
gttcgaagcctcccg

SEQ ID NO: 44804 - DNA, 15 bp, Homo sapiens
ttcgaagcctcccgt

SEQ ID NO: 44805 - DNA, 15 bp, Homo sapiens
tcgaagcctcccgtc

SEQ ID NO: 44806 - DNA, 15 bp, Homo sapiens
cgaagcctcccgtct

SEQ ID NO: 44807 - DNA, 15 bp, Homo sapiens
gaagcctcccgtctg

SEQ ID NO: 44808 - DNA, 15 bp, Homo sapiens
aagcctcccgtctgt

SEQ ID NO: 44809 - DNA, 15 bp, Homo sapiens
agcctcccgtctgtg

SEQ ID NO: 44810 - DNA, 15 bp, Homo sapiens
gcctcccgtctgtgg

SEQ ID NO: 44811 - DNA, 15 bp, Homo sapiens
cctcccgtctgtgga

SEQ ID NO: 44812 - DNA, 15 bp, Homo sapiens
ctcccgtctgtggaa

SEQ ID NO: 44813 - DNA, 15 bp, Homo sapiens
tcccgtctgtggaaa

SEQ ID NO: 44814 - DNA, 15 bp, Homo sapiens
cccgtctgtggaaac

SEQ ID NO: 44815 - DNA, 15 bp, Homo sapiens
ccgtctgtggaaacc

SEQ ID NO: 44816 - DNA, 15 bp, Homo sapiens
cgtctgtggaaaccc

SEQ ID NO: 44817 - DNA, 15 bp, Homo sapiens
gtctgtggaaaccct

SEQ ID NO: 44818 - DNA, 15 bp, Homo sapiens
tctgtggaaaccctt

SEQ ID NO: 44819 - DNA, 15 bp, Homo sapiens
ctgtggaaacccttg

SEQ ID NO: 44820 - DNA, 15 bp, Homo sapiens
tgtggaaacccttgg

SEQ ID NO: 44821 - DNA, 15 bp, Homo sapiens
gtggaaacccttggt

SEQ ID NO: 44822 - DNA, 15 bp, Homo sapiens
tggaaacccttggtt

SEQ ID NO: 44823 - DNA, 15 bp, Homo sapiens
ggaaacccttggttg

SEQ ID NO: 44824 - DNA, 15 bp, Homo sapiens
gaaacccttggttgt

SEQ ID NO: 44825 - DNA, 15 bp, Homo sapiens
aaacccttggttgta

SEQ ID NO: 44826 - DNA, 15 bp, Homo sapiens
aacccttggttgtac

SEQ ID NO: 44827 - DNA, 15 bp, Homo sapiens
acccttggttgtact

SEQ ID NO: 44828 - DNA, 15 bp, Homo sapiens
cccttggttgtactt

SEQ ID NO: 44829 - DNA, 15 bp, Homo sapiens
ccttggttgtacttc

SEQ ID NO: 44830 - DNA, 15 bp, Homo sapiens
cttggttgtacttct

SEQ ID NO: 44831 - DNA, 15 bp, Homo sapiens
ttggttgtacttctg

SEQ ID NO: 44832 - DNA, 15 bp, Homo sapiens
tggttgtacttctgt

SEQ ID NO: 44833 - DNA, 15 bp, Homo sapiens
ggttgtacttctgtt

SEQ ID NO: 44834 - DNA, 15 bp, Homo sapiens
gttgtacttctgtta

SEQ ID NO: 44835 - DNA, 15 bp, Homo sapiens
ttgtacttctgttat

SEQ ID NO: 44836 - DNA, 15 bp, Homo sapiens
tgtacttctgttatc

SEQ ID NO: 44837 - DNA, 15 bp, Homo sapiens
gtacttctgttatct

SEQ ID NO: 44838 - DNA, 15 bp, Homo sapiens
tacttctgttatctg

SEQ ID NO: 44839 - DNA, 15 bp, Homo sapiens
acttctgttatctgc

SEQ ID NO: 44840 - DNA, 15 bp, Homo sapiens
cttctgttatctgct

SEQ ID NO: 44841 - DNA, 15 bp, Homo sapiens
ttctgttatctgctc

SEQ ID NO: 44842 - DNA, 15 bp, Homo sapiens
tctgttatctgctca

SEQ ID NO: 44843 - DNA, 15 bp, Homo sapiens
ctgttatctgctcag

SEQ ID NO: 44844 - DNA, 15 bp, Homo sapiens
tgttatctgctcaga

SEQ ID NO: 44845 - DNA, 15 bp, Homo sapiens
gttatctgctcagac

SEQ ID NO: 44846 - DNA, 15 bp, Homo sapiens
ttatctgctcagaca

SEQ ID NO: 44847 - DNA, 15 bp, Homo sapiens
tatctgctcagacaa

SEQ ID NO: 44848 - DNA, 15 bp, Homo sapiens
atctgctcagacaag

SEQ ID NO: 44849 - DNA, 15 bp, Homo sapiens
tctgctcagacaaga

SEQ ID NO: 44850 - DNA, 15 bp, Homo sapiens
ctgctcagacaagac

SEQ ID NO: 44851 - DNA, 15 bp, Homo sapiens
tgctcagacaagact

SEQ ID NO: 44852 - DNA, 15 bp, Homo sapiens
gctcagacaagactg

SEQ ID NO: 44853 - DNA, 15 bp, Homo sapiens
ctcagacaagactgg

SEQ ID NO: 44854 - DNA, 15 bp, Homo sapiens
tcagacaagactggt

SEQ ID NO: 44855 - DNA, 15 bp, Homo sapiens
cagacaagactggta

SEQ ID NO: 44856 - DNA, 15 bp, Homo sapiens
agacaagactggtac

SEQ ID NO: 44857 - DNA, 15 bp, Homo sapiens
gacaagactggtaca

SEQ ID NO: 44858 - DNA, 15 bp, Homo sapiens
acaagactggtacac

SEQ ID NO: 44859 - DNA, 15 bp, Homo sapiens
caagactggtacact

SEQ ID NO: 44860 - DNA, 15 bp, Homo sapiens
aagactggtacactt

SEQ ID NO: 44861 - DNA, 15 bp, Homo sapiens
agactggtacactta

SEQ ID NO: 44862 - DNA, 15 bp, Homo sapiens
gactggtacacttac

SEQ ID NO: 44863 - DNA, 15 bp, Homo sapiens
actggtacacttaca

SEQ ID NO: 44864 - DNA, 15 bp, Homo sapiens
ctggtacacttacaa

SEQ ID NO: 44865 - DNA, 15 bp, Homo sapiens
tggtacacttacaac

SEQ ID NO: 44866 - DNA, 15 bp, Homo sapiens
ggtacacttacaaca

SEQ ID NO: 44867 - DNA, 15 bp, Homo sapiens
gtacacttacaacaa

SEQ ID NO: 44868 - DNA, 15 bp, Homo sapiens
tacacttacaacaaa

SEQ ID NO: 44869 - DNA, 15 bp, Homo sapiens
acacttacaacaaac

SEQ ID NO: 44870 - DNA, 15 bp, Homo sapiens
cacttacaacaaacc

SEQ ID NO: 44871 - DNA, 15 bp, Homo sapiens
acttacaacaaacca

SEQ ID NO: 44872 - DNA, 15 bp, Homo sapiens
cttacaacaaaccag

SEQ ID NO: 44873 - DNA, 15 bp, Homo sapiens
ttacaacaaaccaga

SEQ ID NO: 44874 - DNA, 15 bp, Homo sapiens
tacaacaaaccagat

SEQ ID NO: 44875 - DNA, 15 bp, Homo sapiens
acaacaaaccagatg

SEQ ID NO: 44876 - DNA, 15 bp, Homo sapiens
caacaaaccagatgt

SEQ ID NO: 44877 - DNA, 15 bp, Homo sapiens
aacaaaccagatgtc

SEQ ID NO: 44878 - DNA, 15 bp, Homo sapiens
acaaaccagatgtca

SEQ ID NO: 44879 - DNA, 15 bp, Homo sapiens
caaaccagatgtcag

SEQ ID NO: 44880 - DNA, 15 bp, Homo sapiens
aaaccagatgtcagt

SEQ ID NO: 44881 - DNA, 15 bp, Homo sapiens
aaccagatgtcagtc

SEQ ID NO: 44882 - DNA, 15 bp, Homo sapiens
accagatgtcagtct

SEQ ID NO: 44883 - DNA, 15 bp, Homo sapiens
ccagatgtcagtctg

SEQ ID NO: 44884 - DNA, 15 bp, Homo sapiens
cagatgtcagtctgc

SEQ ID NO: 44885 - DNA, 15 bp, Homo sapiens
agatgtcagtctgca

SEQ ID NO: 44886 - DNA, 15 bp, Homo sapiens
gatgtcagtctgcag

SEQ ID NO: 44887 - DNA, 15 bp, Homo sapiens
atgtcagtctgcagg

SEQ ID NO: 44888 - DNA, 15 bp, Homo sapiens
tgtcagtctgcaggg

SEQ ID NO: 44889 - DNA, 15 bp, Homo sapiens
gtcagtctgcagggt

SEQ ID NO: 44890 - DNA, 15 bp, Homo sapiens
tcagtctgcagggta

SEQ ID NO: 44891 - DNA, 15 bp, Homo sapiens
cagtctgcagggtaa

SEQ ID NO: 44892 - DNA, 15 bp, Homo sapiens
agtctgcagggtaag

SEQ ID NO: 44893 - DNA, 15 bp, Homo sapiens
gtctgcagggtaaga

SEQ ID NO: 44894 - DNA, 15 bp, Homo sapiens
tctgcagggtaagag

SEQ ID NO: 44895 - DNA, 15 bp, Homo sapiens
ctgcagggtaagagg

SEQ ID NO: 44896 - DNA, 15 bp, Homo sapiens
tgcagggtaagagga

SEQ ID NO: 44897 - DNA, 15 bp, Homo sapiens
gcagggtaagaggag

SEQ ID NO: 44898 - DNA, 15 bp, Homo sapiens
cagggtaagaggagt

SEQ ID NO: 44899 - DNA, 15 bp, Homo sapiens
agggtaagaggagta

SEQ ID NO: 44900 - DNA, 15 bp, Homo sapiens
gggtaagaggagtaa

SEQ ID NO: 44901 - DNA, 15 bp, Homo sapiens
ggtaagaggagtaat

SEQ ID NO: 44902 - DNA, 15 bp, Homo sapiens
gtaagaggagtaatt

SEQ ID NO: 44903 - DNA, 15 bp, Homo sapiens
taagaggagtaattt

SEQ ID NO: 44904 - DNA, 15 bp, Homo sapiens
aagaggagtaattta

SEQ ID NO: 44905 - DNA, 15 bp, Homo sapiens
agaggagtaatttag

SEQ ID NO: 44906 - DNA, 15 bp, Homo sapiens
gaggagtaatttaga

SEQ ID NO: 44907 - DNA, 15 bp, Homo sapiens
aggagtaatttagaa

SEQ ID NO: 44908 - DNA, 15 bp, Homo sapiens
ggagtaatttagaat

SEQ ID NO: 44909 - DNA, 15 bp, Homo sapiens
gagtaatttagaata

SEQ ID NO: 44910 - DNA, 15 bp, Homo sapiens
agtaatttagaatat

SEQ ID NO: 44911 - DNA, 15 bp, Homo sapiens
gtaatttagaatatt

SEQ ID NO: 44912 - DNA, 15 bp, Homo sapiens
taatttagaatattc

SEQ ID NO: 44913 - DNA, 15 bp, Homo sapiens
aatttagaatattcc

SEQ ID NO: 44914 - DNA, 15 bp, Homo sapiens
atttagaatattccg

SEQ ID NO: 44915 - DNA, 15 bp, Homo sapiens
tttagaatattccgt

SEQ ID NO: 44916 - DNA, 15 bp, Homo sapiens
ttagaatattccgtg

SEQ ID NO: 44917 - DNA, 15 bp, Homo sapiens
tagaatattccgtgt

SEQ ID NO: 44918 - DNA, 15 bp, Homo sapiens
agaatattccgtgtc

SEQ ID NO: 44919 - DNA, 15 bp, Homo sapiens
gaatattccgtgtcg

SEQ ID NO: 44920 - DNA, 15 bp, Homo sapiens
aatattccgtgtcgt

SEQ ID NO: 44921 - DNA, 15 bp, Homo sapiens
atattccgtgtcgtg

SEQ ID NO: 44922 - DNA, 15 bp, Homo sapiens
tattccgtgtcgtgg

SEQ ID NO: 44923 - DNA, 15 bp, Homo sapiens
attccgtgtcgtggt

SEQ ID NO: 44924 - DNA, 15 bp, Homo sapiens
ttccgtgtcgtggtt

SEQ ID NO: 44925 - DNA, 15 bp, Homo sapiens
tccgtgtcgtggttc

SEQ ID NO: 44926 - DNA, 15 bp, Homo sapiens
ccgtgtcgtggttct

SEQ ID NO: 44927 - DNA, 15 bp, Homo sapiens
cgtgtcgtggttctt

SEQ ID NO: 44928 - DNA, 15 bp, Homo sapiens
gtgtcgtggttcttt

SEQ ID NO: 44929 - DNA, 15 bp, Homo sapiens
tgtcgtggttctttg

SEQ ID NO: 44930 - DNA, 15 bp, Homo sapiens
gtcgtggttctttgt

SEQ ID NO: 44931 - DNA, 15 bp, Homo sapiens
tcgtggttctttgtt

SEQ ID NO: 44932 - DNA, 15 bp, Homo sapiens
cgtggttctttgttc

SEQ ID NO: 44933 - DNA, 15 bp, Homo sapiens
gtggttctttgttca

SEQ ID NO: 44934 - DNA, 15 bp, Homo sapiens
tggttctttgttcat

SEQ ID NO: 44935 - DNA, 15 bp, Homo sapiens
ggttctttgttcatc

SEQ ID NO: 44936 - DNA, 15 bp, Homo sapiens
gttctttgttcatcc

SEQ ID NO: 44937 - DNA, 15 bp, Homo sapiens
ttctttgttcatcct

SEQ ID NO: 44938 - DNA, 15 bp, Homo sapiens
tctttgttcatccta

SEQ ID NO: 44939 - DNA, 15 bp, Homo sapiens
ctttgttcatcctac

SEQ ID NO: 44940 - DNA, 15 bp, Homo sapiens
tttgttcatcctacc

SEQ ID NO: 44941 - DNA, 15 bp, Homo sapiens
ttgttcatcctacca

SEQ ID NO: 44942 - DNA, 15 bp, Homo sapiens
tgttcatcctaccaa

SEQ ID NO: 44943 - DNA, 15 bp, Homo sapiens
gttcatcctaccaat

SEQ ID NO: 44944 - DNA, 15 bp, Homo sapiens
ttcatcctaccaata

SEQ ID NO: 44945 - DNA, 15 bp, Homo sapiens
tcatcctaccaatat

SEQ ID NO: 44946 - DNA, 15 bp, Homo sapiens
catcctaccaatatg

SEQ ID NO: 44947 - DNA, 15 bp, Homo sapiens
atcctaccaatatgc

SEQ ID NO: 44948 - DNA, 15 bp, Homo sapiens
tcctaccaatatgcc

SEQ ID NO: 44949 - DNA, 15 bp, Homo sapiens
cctaccaatatgcct

SEQ ID NO: 44950 - DNA, 15 bp, Homo sapiens
ctaccaatatgcctt

SEQ ID NO: 44951 - DNA, 15 bp, Homo sapiens
taccaatatgccttc

SEQ ID NO: 44952 - DNA, 15 bp, Homo sapiens
accaatatgccttca

SEQ ID NO: 44953 - DNA, 15 bp, Homo sapiens
ccaatatgccttcat

SEQ ID NO: 44954 - DNA, 15 bp, Homo sapiens
caatatgccttcatg

SEQ ID NO: 44955 - DNA, 15 bp, Homo sapiens
aatatgccttcatgc

SEQ ID NO: 44956 - DNA, 15 bp, Homo sapiens
atatgccttcatgcc

SEQ ID NO: 44957 - DNA, 15 bp, Homo sapiens
tatgccttcatgcca

SEQ ID NO: 44958 - DNA, 15 bp, Homo sapiens
atgccttcatgccat

SEQ ID NO: 44959 - DNA, 15 bp, Homo sapiens
tgccttcatgccatc

SEQ ID NO: 44960 - DNA, 15 bp, Homo sapiens
gccttcatgccatca

SEQ ID NO: 44961 - DNA, 15 bp, Homo sapiens
ccttcatgccatcaa

SEQ ID NO: 44962 - DNA, 15 bp, Homo sapiens
cttcatgccatcaaa

SEQ ID NO: 44963 - DNA, 15 bp, Homo sapiens
ttcatgccatcaaaa

SEQ ID NO: 44964 - DNA, 15 bp, Homo sapiens
tcatgccatcaaaac

SEQ ID NO: 44965 - DNA, 15 bp, Homo sapiens
catgccatcaaaact

SEQ ID NO: 44966 - DNA, 15 bp, Homo sapiens
atgccatcaaaactt

SEQ ID NO: 44967 - DNA, 15 bp, Homo sapiens
tgccatcaaaacttt

SEQ ID NO: 44968 - DNA, 15 bp, Homo sapiens
gccatcaaaactttt

SEQ ID NO: 44969 - DNA, 15 bp, Homo sapiens
ccatcaaaacttttg

SEQ ID NO: 44970 - DNA, 15 bp, Homo sapiens
catcaaaacttttga

SEQ ID NO: 44971 - DNA, 15 bp, Homo sapiens
atcaaaacttttgat

SEQ ID NO: 44972 - DNA, 15 bp, Homo sapiens
tcaaaacttttgatt

SEQ ID NO: 44973 - DNA, 15 bp, Homo sapiens
caaaacttttgattt

SEQ ID NO: 44974 - DNA, 15 bp, Homo sapiens
aaaacttttgatttg

SEQ ID NO: 44975 - DNA, 15 bp, Homo sapiens
aaacttttgatttgt

SEQ ID NO: 44976 - DNA, 15 bp, Homo sapiens
aacttttgatttgta

SEQ ID NO: 44977 - DNA, 15 bp, Homo sapiens
acttttgatttgtaa

SEQ ID NO: 44978 - DNA, 15 bp, Homo sapiens
cttttgatttgtaat

SEQ ID NO: 44979 - DNA, 15 bp, Homo sapiens
ttttgatttgtaatt

SEQ ID NO: 44980 - DNA, 15 bp, Homo sapiens
tttgatttgtaattt

SEQ ID NO: 44981 - DNA, 15 bp, Homo sapiens
ttgatttgtaatttc

SEQ ID NO: 44982 - DNA, 15 bp, Homo sapiens
tgatttgtaatttca

SEQ ID NO: 44983 - DNA, 15 bp, Homo sapiens
gatttgtaatttcat

SEQ ID NO: 44984 - DNA, 15 bp, Homo sapiens
atttgtaatttcata

SEQ ID NO: 44985 - DNA, 15 bp, Homo sapiens
tttgtaatttcatac

SEQ ID NO: 44986 - DNA, 15 bp, Homo sapiens
ttgtaatttcataca

SEQ ID NO: 44987 - DNA, 15 bp, Homo sapiens
tgtaatttcatacat

SEQ ID NO: 44988 - DNA, 15 bp, Homo sapiens
gtaatttcatacatt

SEQ ID NO: 44989 - DNA, 15 bp, Homo sapiens
taatttcatacattt

SEQ ID NO: 44990 - DNA, 15 bp, Homo sapiens
aatttcatacatttc

SEQ ID NO: 44991 - DNA, 15 bp, Homo sapiens
atttcatacatttct

SEQ ID NO: 44992 - DNA, 15 bp, Homo sapiens
tttcatacatttctg

SEQ ID NO: 44993 - DNA, 15 bp, Homo sapiens
ttcatacatttctgt

SEQ ID NO: 44994 - DNA, 15 bp, Homo sapiens
tcatacatttctgtg

SEQ ID NO: 44995 - DNA, 15 bp, Homo sapiens
catacatttctgtgg

SEQ ID NO: 44996 - DNA, 15 bp, Homo sapiens
atacatttctgtggg

SEQ ID NO: 44997 - DNA, 15 bp, Homo sapiens
tacatttctgtgggc

SEQ ID NO: 44998 - DNA, 15 bp, Homo sapiens
acatttctgtgggct

SEQ ID NO: 44999 - DNA, 15 bp, Homo sapiens
catttctgtgggctg

SEQ ID NO: 45000 - DNA, 15 bp, Homo sapiens
atttctgtgggctgt

SEQ ID NO: 45001 - DNA, 15 bp, Homo sapiens
tttctgtgggctgta

SEQ ID NO: 45002 - DNA, 15 bp, Homo sapiens
ttctgtgggctgtat

SEQ ID NO: 45003 - DNA, 15 bp, Homo sapiens
tctgtgggctgtatg

SEQ ID NO: 45004 - DNA, 15 bp, Homo sapiens
ctgtgggctgtatgt

SEQ ID NO: 45005 - DNA, 15 bp, Homo sapiens
tgtgggctgtatgta

SEQ ID NO: 45006 - DNA, 15 bp, Homo sapiens
gtgggctgtatgtat

SEQ ID NO: 45007 - DNA, 15 bp, Homo sapiens
tgggctgtatgtata

SEQ ID NO: 45008 - DNA, 15 bp, Homo sapiens
gggctgtatgtatag

SEQ ID NO: 45009 - DNA, 15 bp, Homo sapiens
ggctgtatgtatagc

SEQ ID NO: 45010 - DNA, 15 bp, Homo sapiens
gctgtatgtatagcc

SEQ ID NO: 45011 - DNA, 15 bp, Homo sapiens
ctgtatgtatagcct

SEQ ID NO: 45012 - DNA, 15 bp, Homo sapiens
tgtatgtatagcctg

SEQ ID NO: 45013 - DNA, 15 bp, Homo sapiens
gtatgtatagcctga

SEQ ID NO: 45014 - DNA, 15 bp, Homo sapiens
tatgtatagcctgag

SEQ ID NO: 45015 - DNA, 15 bp, Homo sapiens
atgtatagcctgagc

SEQ ID NO: 45016 - DNA, 15 bp, Homo sapiens
tgtatagcctgagct

SEQ ID NO: 45017 - DNA, 15 bp, Homo sapiens
gtatagcctgagctt

SEQ ID NO: 45018 - DNA, 15 bp, Homo sapiens
tatagcctgagctta

SEQ ID NO: 45019 - DNA, 15 bp, Homo sapiens
atagcctgagcttaa

SEQ ID NO: 45020 - DNA, 15 bp, Homo sapiens
tagcctgagcttaat

SEQ ID NO: 45021 - DNA, 15 bp, Homo sapiens
agcctgagcttaatt

SEQ ID NO: 45022 - DNA, 15 bp, Homo sapiens
gcctgagcttaattt

SEQ ID NO: 45023 - DNA, 15 bp, Homo sapiens
cctgagcttaatttc

SEQ ID NO: 45024 - DNA, 15 bp, Homo sapiens
ctgagcttaatttct

SEQ ID NO: 45025 - DNA, 15 bp, Homo sapiens
tgagcttaatttcta

SEQ ID NO: 45026 - DNA, 15 bp, Homo sapiens
gagcttaatttctaa

SEQ ID NO: 45027 - DNA, 15 bp, Homo sapiens
agcttaatttctaat

SEQ ID NO: 45028 - DNA, 15 bp, Homo sapiens
gcttaatttctaata

SEQ ID NO: 45029 - DNA, 15 bp, Homo sapiens
cttaatttctaatat

SEQ ID NO: 45030 - DNA, 15 bp, Homo sapiens
ttaatttctaatatt

SEQ ID NO: 45031 - DNA, 15 bp, Homo sapiens
taatttctaatattt

SEQ ID NO: 45032 - DNA, 15 bp, Homo sapiens
aatttctaatatttg

SEQ ID NO: 45033 - DNA, 15 bp, Homo sapiens
atttctaatatttga

SEQ ID NO: 45034 - DNA, 15 bp, Homo sapiens
tttctaatatttgag

SEQ ID NO: 45035 - DNA, 15 bp, Homo sapiens
ttctaatatttgaga

SEQ ID NO: 45036 - DNA, 15 bp, Homo sapiens
tctaatatttgagag

SEQ ID NO: 45037 - DNA, 15 bp, Homo sapiens
ctaatatttgagagg

SEQ ID NO: 45038 - DNA, 15 bp, Homo sapiens
taatatttgagagga

SEQ ID NO: 45039 - DNA, 15 bp, Homo sapiens
aatatttgagaggat

SEQ ID NO: 45040 - DNA, 15 bp, Homo sapiens
atatttgagaggatc

SEQ ID NO: 45041 - DNA, 15 bp, Homo sapiens
tatttgagaggatct

SEQ ID NO: 45042 - DNA, 15 bp, Homo sapiens
atttgagaggatcta

SEQ ID NO: 45043 - DNA, 15 bp, Homo sapiens
tttgagaggatctaa

SEQ ID NO: 45044 - DNA, 15 bp, Homo sapiens
ttgagaggatctaat

SEQ ID NO: 45045 - DNA, 15 bp, Homo sapiens
tgagaggatctaatc

SEQ ID NO: 45046 - DNA, 15 bp, Homo sapiens
gagaggatctaatca

SEQ ID NO: 45047 - DNA, 15 bp, Homo sapiens
agaggatctaatcat

SEQ ID NO: 45048 - DNA, 15 bp, Homo sapiens
gaggatctaatcatt

SEQ ID NO: 45049 - DNA, 15 bp, Homo sapiens
aggatctaatcattt

SEQ ID NO: 45050 - DNA, 15 bp, Homo sapiens
ggatctaatcattta

SEQ ID NO: 45051 - DNA, 15 bp, Homo sapiens
gatctaatcatttaa

SEQ ID NO: 45052 - DNA, 15 bp, Homo sapiens
atctaatcatttaat

SEQ ID NO: 45053 - DNA, 15 bp, Homo sapiens
tctaatcatttaatt

SEQ ID NO: 45054 - DNA, 15 bp, Homo sapiens
ctaatcatttaattc

SEQ ID NO: 45055 - DNA, 15 bp, Homo sapiens
taatcatttaattcc

SEQ ID NO: 45056 - DNA, 15 bp, Homo sapiens
aatcatttaattcct

SEQ ID NO: 45057 - DNA, 15 bp, Homo sapiens
atcatttaattccta

SEQ ID NO: 45058 - DNA, 15 bp, Homo sapiens
tcatttaattcctaa

SEQ ID NO: 45059 - DNA, 15 bp, Homo sapiens
catttaattcctaaa

SEQ ID NO: 45060 - DNA, 15 bp, Homo sapiens
atttaattcctaaaa

SEQ ID NO: 45061 - DNA, 15 bp, Homo sapiens
tttaattcctaaaac

SEQ ID NO: 45062 - DNA, 15 bp, Homo sapiens
ttaattcctaaaact

SEQ ID NO: 45063 - DNA, 15 bp, Homo sapiens
taattcctaaaactt

SEQ ID NO: 45064 - DNA, 15 bp, Homo sapiens
aattcctaaaacttt

SEQ ID NO: 45065 - DNA, 15 bp, Homo sapiens
attcctaaaactttc

SEQ ID NO: 45066 - DNA, 15 bp, Homo sapiens
ttcctaaaactttca

SEQ ID NO: 45067 - DNA, 15 bp, Homo sapiens
tcctaaaactttcac

SEQ ID NO: 45068 - DNA, 15 bp, Homo sapiens
cctaaaactttcaca

SEQ ID NO: 45069 - DNA, 15 bp, Homo sapiens
ctaaaactttcacaa

SEQ ID NO: 45070 - DNA, 15 bp, Homo sapiens
taaaactttcacaaa

SEQ ID NO: 45071 - DNA, 15 bp, Homo sapiens
aaaactttcacaaaa

SEQ ID NO: 45072 - DNA, 15 bp, Homo sapiens
aaactttcacaaaat

SEQ ID NO: 45073 - DNA, 15 bp, Homo sapiens
aactttcacaaaata

SEQ ID NO: 45074 - DNA, 15 bp, Homo sapiens
actttcacaaaatac

SEQ ID NO: 45075 - DNA, 15 bp, Homo sapiens
ctttcacaaaataca

SEQ ID NO: 45076 - DNA, 15 bp, Homo sapiens
tttcacaaaatacag

SEQ ID NO: 45077 - DNA, 15 bp, Homo sapiens
ttcacaaaatacagg

SEQ ID NO: 45078 - DNA, 15 bp, Homo sapiens
tcacaaaatacagga

SEQ ID NO: 45079 - DNA, 15 bp, Homo sapiens
cacaaaatacaggat

SEQ ID NO: 45080 - DNA, 15 bp, Homo sapiens
acaaaatacaggata

SEQ ID NO: 45081 - DNA, 15 bp, Homo sapiens
caaaatacaggatat

SEQ ID NO: 45082 - DNA, 15 bp, Homo sapiens
aaaatacaggatatc

SEQ ID NO: 45083 - DNA, 15 bp, Homo sapiens
aaatacaggatatct

SEQ ID NO: 45084 - DNA, 15 bp, Homo sapiens
aatacaggatatctg

SEQ ID NO: 45085 - DNA, 15 bp, Homo sapiens
atacaggatatctgt

SEQ ID NO: 45086 - DNA, 15 bp, Homo sapiens
tacaggatatctgta

SEQ ID NO: 45087 - DNA, 15 bp, Homo sapiens
acaggatatctgtat

SEQ ID NO: 45088 - DNA, 15 bp, Homo sapiens
caggatatctgtatg

SEQ ID NO: 45089 - DNA, 15 bp, Homo sapiens
aggatatctgtatgg

SEQ ID NO: 45090 - DNA, 15 bp, Homo sapiens
ggatatctgtatggc

SEQ ID NO: 45091 - DNA, 15 bp, Homo sapiens
gatatctgtatggct

SEQ ID NO: 45092 - DNA, 15 bp, Homo sapiens
atatctgtatggctg

SEQ ID NO: 45093 - DNA, 15 bp, Homo sapiens
tatctgtatggctga

SEQ ID NO: 45094 - DNA, 15 bp, Homo sapiens
atctgtatggctgat

SEQ ID NO: 45095 - DNA, 15 bp, Homo sapiens
tctgtatggctgata

SEQ ID NO: 45096 - DNA, 15 bp, Homo sapiens
ctgtatggctgatat

SEQ ID NO: 45097 - DNA, 15 bp, Homo sapiens
tgtatggctgatata

SEQ ID NO: 45098 - DNA, 15 bp, Homo sapiens
gtatggctgatatac

SEQ ID NO: 45099 - DNA, 15 bp, Homo sapiens
tatggctgatatact

SEQ ID NO: 45100 - DNA, 15 bp, Homo sapiens
atggctgatatactt

SEQ ID NO: 45101 - DNA, 15 bp, Homo sapiens
tggctgatatacttg

SEQ ID NO: 45102 - DNA, 15 bp, Homo sapiens
ggctgatatacttgt

SEQ ID NO: 45103 - DNA, 15 bp, Homo sapiens
gctgatatacttgta

SEQ ID NO: 45104 - DNA, 15 bp, Homo sapiens
ctgatatacttgtat

SEQ ID NO: 45105 - DNA, 15 bp, Homo sapiens
tgatatacttgtatt

SEQ ID NO: 45106 - DNA, 15 bp, Homo sapiens
gatatacttgtatta

SEQ ID NO: 45107 - DNA, 15 bp, Homo sapiens
atatacttgtattag

SEQ ID NO: 45108 - DNA, 15 bp, Homo sapiens
tatacttgtattaga

SEQ ID NO: 45109 - DNA, 15 bp, Homo sapiens
atacttgtattagat

SEQ ID NO: 45110 - DNA, 15 bp, Homo sapiens
tacttgtattagatg

SEQ ID NO: 45111 - DNA, 15 bp, Homo sapiens
acttgtattagatgt

SEQ ID NO: 45112 - DNA, 15 bp, Homo sapiens
cttgtattagatgta

SEQ ID NO: 45113 - DNA, 15 bp, Homo sapiens
ttgtattagatgtaa

SEQ ID NO: 45114 - DNA, 15 bp, Homo sapiens
tgtattagatgtaag

SEQ ID NO: 45115 - DNA, 15 bp, Homo sapiens
gtattagatgtaaga

SEQ ID NO: 45116 - DNA, 15 bp, Homo sapiens
tattagatgtaagag

SEQ ID NO: 45117 - DNA, 15 bp, Homo sapiens
attagatgtaagaga

SEQ ID NO: 45118 - DNA, 15 bp, Homo sapiens
ttagatgtaagagaa

SEQ ID NO: 45119 - DNA, 15 bp, Homo sapiens
tagatgtaagagaat

SEQ ID NO: 45120 - DNA, 15 bp, Homo sapiens
agatgtaagagaatt

SEQ ID NO: 45121 - DNA, 15 bp, Homo sapiens
gatgtaagagaatta

SEQ ID NO: 45122 - DNA, 15 bp, Homo sapiens
atgtaagagaattag

SEQ ID NO: 45123 - DNA, 15 bp, Homo sapiens
tgtaagagaattaga

SEQ ID NO: 45124 - DNA, 15 bp, Homo sapiens
gtaagagaattagag

SEQ ID NO: 45125 - DNA, 15 bp, Homo sapiens
taagagaattagaga

SEQ ID NO: 45126 - DNA, 15 bp, Homo sapiens
aagagaattagagaa

SEQ ID NO: 45127 - DNA, 15 bp, Homo sapiens
agagaattagagaaa

SEQ ID NO: 45128 - DNA, 15 bp, Homo sapiens
gagaattagagaaat

SEQ ID NO: 45129 - DNA, 15 bp, Homo sapiens
agaattagagaaatt

SEQ ID NO: 45130 - DNA, 15 bp, Homo sapiens
gaattagagaaatta

SEQ ID NO: 45131 - DNA, 15 bp, Homo sapiens
aattagagaaattat

SEQ ID NO: 45132 - DNA, 15 bp, Homo sapiens
attagagaaattata

SEQ ID NO: 45133 - DNA, 15 bp, Homo sapiens
ttagagaaattatat

SEQ ID NO: 45134 - DNA, 15 bp, Homo sapiens
tagagaaattatatt

SEQ ID NO: 45135 - DNA, 15 bp, Homo sapiens
agagaaattatattt

SEQ ID NO: 45136 - DNA, 15 bp, Homo sapiens
gagaaattatatttt

SEQ ID NO: 45137 - DNA, 15 bp, Homo sapiens
agaaattatattttc

SEQ ID NO: 45138 - DNA, 15 bp, Homo sapiens
gaaattatattttcc

SEQ ID NO: 45139 - DNA, 15 bp, Homo sapiens
aaattatattttcct

SEQ ID NO: 45140 - DNA, 15 bp, Homo sapiens
aattatattttcctt

SEQ ID NO: 45141 - DNA, 15 bp, Homo sapiens
attatattttccttt

SEQ ID NO: 45142 - DNA, 15 bp, Homo sapiens
ttatattttccttta

SEQ ID NO: 45143 - DNA, 15 bp, Homo sapiens
tatattttcctttaa

SEQ ID NO: 45144 - DNA, 15 bp, Homo sapiens
atattttcctttaat

SEQ ID NO: 45145 - DNA, 15 bp, Homo sapiens
tattttcctttaatt

SEQ ID NO: 45146 - DNA, 15 bp, Homo sapiens
attttcctttaatta

SEQ ID NO: 45147 - DNA, 15 bp, Homo sapiens
ttttcctttaattaa

SEQ ID NO: 45148 - DNA, 15 bp, Homo sapiens
tttcctttaattaaa

SEQ ID NO: 45149 - DNA, 15 bp, Homo sapiens
ttcctttaattaaaa

SEQ ID NO: 45150 - DNA, 15 bp, Homo sapiens
tcctttaattaaaaa

SEQ ID NO: 45151 - DNA, 15 bp, Homo sapiens
cctttaattaaaaaa

SEQ ID NO: 45152 - DNA, 15 bp, Homo sapiens
ctttaattaaaaaaa

SEQ ID NO: 45153 - DNA, 15 bp, Homo sapiens
ttaattaaaaaaaaa

SEQ ID NO: 45154 - DNA, 15 bp, Homo sapiens
taattaaaaaaaaaa

SEQ ID NO: 45155 - DNA, 15 bp, Homo sapiens
aattaaaaaaaaaaa

SEQ ID NO: 45156 - DNA, 15 bp, Homo sapiens
attaaaaaaaaaaaa

SEQ ID NO: 45157 - DNA, 15 bp, Homo sapiens
taaaaaaaaaaaaag

SEQ ID NO: 45158 - DNA, 15 bp, Homo sapiens
aaaaaaaaaaaagcc

SEQ ID NO: 45159 - DNA, 15 bp, Homo sapiens
aaaaaaaaaaagcct

SEQ ID NO: 45160 - DNA, 15 bp, Homo sapiens
aaaaaaaaaagcctg

SEQ ID NO: 45161 - DNA, 15 bp, Homo sapiens
aaaaaaaaagcctgg

SEQ ID NO: 45162 - DNA, 15 bp, Homo sapiens
aaaaaaaagcctggg

SEQ ID NO: 45163 - DNA, 15 bp, Homo sapiens
aaaaaaagcctgggc

SEQ ID NO: 45164 - DNA, 15 bp, Homo sapiens
aaaaaagcctgggcg

SEQ ID NO: 45165 - DNA, 15 bp, Homo sapiens
aaaaagcctgggcgc

SEQ ID NO: 45166 - DNA, 15 bp, Homo sapiens
aaaagcctgggcgca

SEQ ID NO: 45167 - DNA, 15 bp, Homo sapiens
aaagcctgggcgcag

SEQ ID NO: 45168 - DNA, 15 bp, Homo sapiens
aagcctgggcgcagt

SEQ ID NO: 45169 - DNA, 15 bp, Homo sapiens
agcctgggcgcagtg

SEQ ID NO: 45170 - DNA, 15 bp, Homo sapiens
gcctgggcgcagtgg

SEQ ID NO: 45171 - DNA, 15 bp, Homo sapiens
cctgggcgcagtggc

SEQ ID NO: 45172 - DNA, 15 bp, Homo sapiens
ctgggcgcagtggct

SEQ ID NO: 45173 - DNA, 15 bp, Homo sapiens
tgggcgcagtggctc

SEQ ID NO: 45174 - DNA, 15 bp, Homo sapiens
gggcgcagtggctca

SEQ ID NO: 45175 - DNA, 15 bp, Homo sapiens
ggcgcagtggctcac

SEQ ID NO: 45176 - DNA, 15 bp, Homo sapiens
gcgcagtggctcacg

SEQ ID NO: 45177 - DNA, 15 bp, Homo sapiens
cgcagtggctcacgc

SEQ ID NO: 45178 - DNA, 15 bp, Homo sapiens
ttgagaggccgaggc

SEQ ID NO: 45179 - DNA, 15 bp, Homo sapiens
tgagaggccgaggcg

SEQ ID NO: 45180 - DNA, 15 bp, Homo sapiens
gagaggccgaggcgg

SEQ ID NO: 45181 - DNA, 15 bp, Homo sapiens
agaggccgaggcggg

SEQ ID NO: 45182 - DNA, 15 bp, Homo sapiens
gaggccgaggcgggt

SEQ ID NO: 45183 - DNA, 15 bp, Homo sapiens
aggccgaggcgggtg

SEQ ID NO: 45184 - DNA, 15 bp, Homo sapiens
ggccgaggcgggtgg

SEQ ID NO: 45185 - DNA, 15 bp, Homo sapiens
gccgaggcgggtgga

SEQ ID NO: 45186 - DNA, 15 bp, Homo sapiens
ccgaggcgggtggat

SEQ ID NO: 45187 - DNA, 15 bp, Homo sapiens
cgaggcgggtggatc

SEQ ID NO: 45188 - DNA, 15 bp, Homo sapiens
ggcgggtggatcacc

SEQ ID NO: 45189 - DNA, 15 bp, Homo sapiens
gcgggtggatcacct

SEQ ID NO: 45190 - DNA, 15 bp, Homo sapiens
cgggtggatcacctg

SEQ ID NO: 45191 - DNA, 15 bp, Homo sapiens
gggtggatcacctga

SEQ ID NO: 45192 - DNA, 15 bp, Homo sapiens
ggtggatcacctgag

SEQ ID NO: 45193 - DNA, 15 bp, Homo sapiens
gtggatcacctgagg

SEQ ID NO: 45194 - DNA, 15 bp, Homo sapiens
tggatcacctgaggt

SEQ ID NO: 45195 - DNA, 15 bp, Homo sapiens
ggatcacctgaggtc

SEQ ID NO: 45196 - DNA, 15 bp, Homo sapiens
gatcacctgaggtcc

SEQ ID NO: 45197 - DNA, 15 bp, Homo sapiens
atcacctgaggtccg

SEQ ID NO: 45198 - DNA, 15 bp, Homo sapiens
tcacctgaggtccga

SEQ ID NO: 45199 - DNA, 15 bp, Homo sapiens
cacctgaggtccgaa

SEQ ID NO: 45200 - DNA, 15 bp, Homo sapiens
acctgaggtccgaag

SEQ ID NO: 45201 - DNA, 15 bp, Homo sapiens
cctgaggtccgaagt

SEQ ID NO: 45202 - DNA, 15 bp, Homo sapiens
ctgaggtccgaagtt

SEQ ID NO: 45203 - DNA, 15 bp, Homo sapiens
tgaggtccgaagttt

SEQ ID NO: 45204 - DNA, 15 bp, Homo sapiens
gaggtccgaagtttg

SEQ ID NO: 45205 - DNA, 15 bp, Homo sapiens
aggtccgaagtttga

SEQ ID NO: 45206 - DNA, 15 bp, Homo sapiens
ggtccgaagtttgag

SEQ ID NO: 45207 - DNA, 15 bp, Homo sapiens
gtccgaagtttgaga

SEQ ID NO: 45208 - DNA, 15 bp, Homo sapiens
tccgaagtttgagac

SEQ ID NO: 45209 - DNA, 15 bp, Homo sapiens
ccgaagtttgagacc

SEQ ID NO: 45210 - DNA, 15 bp, Homo sapiens
cgaagtttgagacca

SEQ ID NO: 45211 - DNA, 15 bp, Homo sapiens
gaagtttgagaccaa

SEQ ID NO: 45212 - DNA, 15 bp, Homo sapiens
aagtttgagaccaac

SEQ ID NO: 45213 - DNA, 15 bp, Homo sapiens
agtttgagaccaacc

SEQ ID NO: 45214 - DNA, 15 bp, Homo sapiens
gtttgagaccaacct

SEQ ID NO: 45215 - DNA, 15 bp, Homo sapiens
tttgagaccaacctg

SEQ ID NO: 45216 - DNA, 15 bp, Homo sapiens
ttgagaccaacctga

SEQ ID NO: 45217 - DNA, 15 bp, Homo sapiens
tgagaccaacctgac

SEQ ID NO: 45218 - DNA, 15 bp, Homo sapiens
gagaccaacctgacc

SEQ ID NO: 45219 - DNA, 15 bp, Homo sapiens
agaccaacctgacca

SEQ ID NO: 45220 - DNA, 15 bp, Homo sapiens
gaccaacctgaccaa

SEQ ID NO: 45221 - DNA, 15 bp, Homo sapiens
accaacctgaccaaa

SEQ ID NO: 45222 - DNA, 15 bp, Homo sapiens
ccaacctgaccaaaa

SEQ ID NO: 45223 - DNA, 15 bp, Homo sapiens
caacctgaccaaaat

SEQ ID NO: 45224 - DNA, 15 bp, Homo sapiens
aacctgaccaaaatg

SEQ ID NO: 45225 - DNA, 15 bp, Homo sapiens
acctgaccaaaatgg

SEQ ID NO: 45226 - DNA, 15 bp, Homo sapiens
cctgaccaaaatggt

SEQ ID NO: 45227 - DNA, 15 bp, Homo sapiens
ctgaccaaaatggtg

SEQ ID NO: 45228 - DNA, 15 bp, Homo sapiens
tgaccaaaatggtga

SEQ ID NO: 45229 - DNA, 15 bp, Homo sapiens
gaccaaaatggtgaa

SEQ ID NO: 45230 - DNA, 15 bp, Homo sapiens
accaaaatggtgaaa

SEQ ID NO: 45231 - DNA, 15 bp, Homo sapiens
aaccctgtctctacc

SEQ ID NO: 45232 - DNA, 15 bp, Homo sapiens
accctgtctctaccg

SEQ ID NO: 45233 - DNA, 15 bp, Homo sapiens
ccctgtctctaccga

SEQ ID NO: 45234 - DNA, 15 bp, Homo sapiens
cctgtctctaccgaa

SEQ ID NO: 45235 - DNA, 15 bp, Homo sapiens
ctgtctctaccgaaa

SEQ ID NO: 45236 - DNA, 15 bp, Homo sapiens
tgtctctaccgaaaa

SEQ ID NO: 45237 - DNA, 15 bp, Homo sapiens
gtctctaccgaaaag

SEQ ID NO: 45238 - DNA, 15 bp, Homo sapiens
tctctaccgaaaaga

SEQ ID NO: 45239 - DNA, 15 bp, Homo sapiens
ctctaccgaaaagac

SEQ ID NO: 45240 - DNA, 15 bp, Homo sapiens
tctaccgaaaagaca

SEQ ID NO: 45241 - DNA, 15 bp, Homo sapiens
ctaccgaaaagacaa

SEQ ID NO: 45242 - DNA, 15 bp, Homo sapiens
taccgaaaagacaaa

SEQ ID NO: 45243 - DNA, 15 bp, Homo sapiens
accgaaaagacaaaa

SEQ ID NO: 45244 - DNA, 15 bp, Homo sapiens
ccgaaaagacaaaaa

SEQ ID NO: 45245 - DNA, 15 bp, Homo sapiens
cgaaaagacaaaaat

SEQ ID NO: 45246 - DNA, 15 bp, Homo sapiens
gaaaagacaaaaatt

SEQ ID NO: 45247 - DNA, 15 bp, Homo sapiens
aaaagacaaaaatta

SEQ ID NO: 45248 - DNA, 15 bp, Homo sapiens
aaagacaaaaattag

SEQ ID NO: 45249 - DNA, 15 bp, Homo sapiens
aagacaaaaattagc

SEQ ID NO: 45250 - DNA, 15 bp, Homo sapiens
agacaaaaattagct

SEQ ID NO: 45251 - DNA, 15 bp, Homo sapiens
gacaaaaattagctg

SEQ ID NO: 45252 - DNA, 15 bp, Homo sapiens
acaaaaattagctga

SEQ ID NO: 45253 - DNA, 15 bp, Homo sapiens
caaaaattagctgag

SEQ ID NO: 45254 - DNA, 15 bp, Homo sapiens
aaaaattagctgagt

SEQ ID NO: 45255 - DNA, 15 bp, Homo sapiens
aaaattagctgagtg

SEQ ID NO: 45256 - DNA, 15 bp, Homo sapiens
aaattagctgagtgg

SEQ ID NO: 45257 - DNA, 15 bp, Homo sapiens
aattagctgagtggt

SEQ ID NO: 45258 - DNA, 15 bp, Homo sapiens
attagctgagtggtg

SEQ ID NO: 45259 - DNA, 15 bp, Homo sapiens
ttagctgagtggtgg

SEQ ID NO: 45260 - DNA, 15 bp, Homo sapiens
tagctgagtggtggc

SEQ ID NO: 45261 - DNA, 15 bp, Homo sapiens
agctgagtggtggcg

SEQ ID NO: 45262 - DNA, 15 bp, Homo sapiens
gctgagtggtggcgt

SEQ ID NO: 45263 - DNA, 15 bp, Homo sapiens
ctgagtggtggcgtg

SEQ ID NO: 45264 - DNA, 15 bp, Homo sapiens
tgagtggtggcgtgc

SEQ ID NO: 45265 - DNA, 15 bp, Homo sapiens
gagtggtggcgtgca

SEQ ID NO: 45266 - DNA, 15 bp, Homo sapiens
agtggtggcgtgcac

SEQ ID NO: 45267 - DNA, 15 bp, Homo sapiens
gtggtggcgtgcacc

SEQ ID NO: 45268 - DNA, 15 bp, Homo sapiens
gtcccagctactcga

SEQ ID NO: 45269 - DNA, 15 bp, Homo sapiens
tcccagctactcgag

SEQ ID NO: 45270 - DNA, 15 bp, Homo sapiens
cccagctactcgaga

SEQ ID NO: 45271 - DNA, 15 bp, Homo sapiens
ccagctactcgagag

SEQ ID NO: 45272 - DNA, 15 bp, Homo sapiens
cagctactcgagagg

SEQ ID NO: 45273 - DNA, 15 bp, Homo sapiens
agctactcgagaggc

SEQ ID NO: 45274 - DNA, 15 bp, Homo sapiens
gctactcgagaggct

SEQ ID NO: 45275 - DNA, 15 bp, Homo sapiens
ctactcgagaggctg

SEQ ID NO: 45276 - DNA, 15 bp, Homo sapiens
tactcgagaggctga

SEQ ID NO: 45277 - DNA, 15 bp, Homo sapiens
actcgagaggctgag

SEQ ID NO: 45278 - DNA, 15 bp, Homo sapiens
ctcgagaggctgaga

SEQ ID NO: 45279 - DNA, 15 bp, Homo sapiens
tcgagaggctgagac

SEQ ID NO: 45280 - DNA, 15 bp, Homo sapiens
cgagaggctgagaca

SEQ ID NO: 45281 - DNA, 15 bp, Homo sapiens
gagaggctgagacag

SEQ ID NO: 45282 - DNA, 15 bp, Homo sapiens
agaggctgagacagg

SEQ ID NO: 45283 - DNA, 15 bp, Homo sapiens
gaggctgagacagga

SEQ ID NO: 45284 - DNA, 15 bp, Homo sapiens
aggctgagacaggag

SEQ ID NO: 45285 - DNA, 15 bp, Homo sapiens
ggctgagacaggaga

SEQ ID NO: 45286 - DNA, 15 bp, Homo sapiens
gaattgcttgaacct

SEQ ID NO: 45287 - DNA, 15 bp, Homo sapiens
gccacaataaaaata

SEQ ID NO: 45288 - DNA, 15 bp, Homo sapiens
ccacaataaaaataa

SEQ ID NO: 45289 - DNA, 15 bp, Homo sapiens
cacaataaaaataag

SEQ ID NO: 45290 - DNA, 15 bp, Homo sapiens
acaataaaaataagt

SEQ ID NO: 45291 - DNA, 15 bp, Homo sapiens
caataaaaataagtg

SEQ ID NO: 45292 - DNA, 15 bp, Homo sapiens
aataaaaataagtgg

SEQ ID NO: 45293 - DNA, 15 bp, Homo sapiens
ataaaaataagtggg

SEQ ID NO: 45294 - DNA, 15 bp, Homo sapiens
taaaaataagtggga

SEQ ID NO: 45295 - DNA, 15 bp, Homo sapiens
aaaaataagtgggaa

SEQ ID NO: 45296 - DNA, 15 bp, Homo sapiens
aaaataagtgggaag

SEQ ID NO: 45297 - DNA, 15 bp, Homo sapiens
aaataagtgggaagg

SEQ ID NO: 45298 - DNA, 15 bp, Homo sapiens
aataagtgggaagga

SEQ ID NO: 45299 - DNA, 15 bp, Homo sapiens
ataagtgggaaggag

SEQ ID NO: 45300 - DNA, 15 bp, Homo sapiens
taagtgggaaggagc

SEQ ID NO: 45301 - DNA, 15 bp, Homo sapiens
aagtgggaaggagca

SEQ ID NO: 45302 - DNA, 15 bp, Homo sapiens
agtgggaaggagcag

SEQ ID NO: 45303 - DNA, 15 bp, Homo sapiens
gtgggaaggagcaga

SEQ ID NO: 45304 - DNA, 15 bp, Homo sapiens
tgggaaggagcagag

SEQ ID NO: 45305 - DNA, 15 bp, Homo sapiens
gggaaggagcagaga

SEQ ID NO: 45306 - DNA, 15 bp, Homo sapiens
ggaaggagcagagaa

SEQ ID NO: 45307 - DNA, 15 bp, Homo sapiens
gaaggagcagagaag

SEQ ID NO: 45308 - DNA, 15 bp, Homo sapiens
aaggagcagagaagc

SEQ ID NO: 45309 - DNA, 15 bp, Homo sapiens
aggagcagagaagca

SEQ ID NO: 45310 - DNA, 15 bp, Homo sapiens
ggagcagagaagcag

SEQ ID NO: 45311 - DNA, 15 bp, Homo sapiens
gagcagagaagcagt

SEQ ID NO: 45312 - DNA, 15 bp, Homo sapiens
agcagagaagcagtt

SEQ ID NO: 45313 - DNA, 15 bp, Homo sapiens
gcagagaagcagttt

SEQ ID NO: 45314 - DNA, 15 bp, Homo sapiens
cagagaagcagtttg

SEQ ID NO: 45315 - DNA, 15 bp, Homo sapiens
agagaagcagtttgt

SEQ ID NO: 45316 - DNA, 15 bp, Homo sapiens
gagaagcagtttgtc

SEQ ID NO: 45317 - DNA, 15 bp, Homo sapiens
agaagcagtttgtct

SEQ ID NO: 45318 - DNA, 15 bp, Homo sapiens
gaagcagtttgtctt

SEQ ID NO: 45319 - DNA, 15 bp, Homo sapiens
aagcagtttgtctta

SEQ ID NO: 45320 - DNA, 15 bp, Homo sapiens
agcagtttgtcttat

SEQ ID NO: 45321 - DNA, 15 bp, Homo sapiens
gcagtttgtcttatt

SEQ ID NO: 45322 - DNA, 15 bp, Homo sapiens
cagtttgtcttattt

SEQ ID NO: 45323 - DNA, 15 bp, Homo sapiens
agtttgtcttatttt

SEQ ID NO: 45324 - DNA, 15 bp, Homo sapiens
gtttgtcttatttta

SEQ ID NO: 45325 - DNA, 15 bp, Homo sapiens
tttgtcttattttac

SEQ ID NO: 45326 - DNA, 15 bp, Homo sapiens
ttgtcttattttact

SEQ ID NO: 45327 - DNA, 15 bp, Homo sapiens
tgtcttattttactc

SEQ ID NO: 45328 - DNA, 15 bp, Homo sapiens
gtcttattttactcg

SEQ ID NO: 45329 - DNA, 15 bp, Homo sapiens
tcttattttactcgg

SEQ ID NO: 45330 - DNA, 15 bp, Homo sapiens
cttattttactcggg

SEQ ID NO: 45331 - DNA, 15 bp, Homo sapiens
ttattttactcggga

SEQ ID NO: 45332 - DNA, 15 bp, Homo sapiens
tattttactcgggaa

SEQ ID NO: 45333 - DNA, 15 bp, Homo sapiens
attttactcgggaaa

SEQ ID NO: 45334 - DNA, 15 bp, Homo sapiens
ttttactcgggaaat

SEQ ID NO: 45335 - DNA, 15 bp, Homo sapiens
tttactcgggaaatg

SEQ ID NO: 45336 - DNA, 15 bp, Homo sapiens
ttactcgggaaatgt

SEQ ID NO: 45337 - DNA, 15 bp, Homo sapiens
tactcgggaaatgtt

SEQ ID NO: 45338 - DNA, 15 bp, Homo sapiens
actcgggaaatgttt

SEQ ID NO: 45339 - DNA, 15 bp, Homo sapiens
ctcgggaaatgttta

SEQ ID NO: 45340 - DNA, 15 bp, Homo sapiens
tcgggaaatgtttat

SEQ ID NO: 45341 - DNA, 15 bp, Homo sapiens
cgggaaatgtttatg

SEQ ID NO: 45342 - DNA, 15 bp, Homo sapiens
gggaaatgtttatgc

SEQ ID NO: 45343 - DNA, 15 bp, Homo sapiens
ggaaatgtttatgca

SEQ ID NO: 45344 - DNA, 15 bp, Homo sapiens
gaaatgtttatgcaa

SEQ ID NO: 45345 - DNA, 15 bp, Homo sapiens
aaatgtttatgcaac

SEQ ID NO: 45346 - DNA, 15 bp, Homo sapiens
aatgtttatgcaact

SEQ ID NO: 45347 - DNA, 15 bp, Homo sapiens
atgtttatgcaactc

SEQ ID NO: 45348 - DNA, 15 bp, Homo sapiens
tgtttatgcaactct

SEQ ID NO: 45349 - DNA, 15 bp, Homo sapiens
gtttatgcaactctg

SEQ ID NO: 45350 - DNA, 15 bp, Homo sapiens
tttatgcaactctga

SEQ ID NO: 45351 - DNA, 15 bp, Homo sapiens
ttatgcaactctgaa

SEQ ID NO: 45352 - DNA, 15 bp, Homo sapiens
tatgcaactctgaaa

SEQ ID NO: 45353 - DNA, 15 bp, Homo sapiens
atgcaactctgaaat

SEQ ID NO: 45354 - DNA, 15 bp, Homo sapiens
tgcaactctgaaatg

SEQ ID NO: 45355 - DNA, 15 bp, Homo sapiens
gcaactctgaaatgt

SEQ ID NO: 45356 - DNA, 15 bp, Homo sapiens
caactctgaaatgtg

SEQ ID NO: 45357 - DNA, 15 bp, Homo sapiens
aactctgaaatgtga

SEQ ID NO: 45358 - DNA, 15 bp, Homo sapiens
actctgaaatgtgag

SEQ ID NO: 45359 - DNA, 15 bp, Homo sapiens
ctctgaaatgtgagt

SEQ ID NO: 45360 - DNA, 15 bp, Homo sapiens
tctgaaatgtgagtt

SEQ ID NO: 45361 - DNA, 15 bp, Homo sapiens
ctgaaatgtgagttt

SEQ ID NO: 45362 - DNA, 15 bp, Homo sapiens
tgaaatgtgagttta

SEQ ID NO: 45363 - DNA, 15 bp, Homo sapiens
gaaatgtgagtttat

SEQ ID NO: 45364 - DNA, 15 bp, Homo sapiens
aaatgtgagtttatt

SEQ ID NO: 45365 - DNA, 15 bp, Homo sapiens
aatgtgagtttattc

SEQ ID NO: 45366 - DNA, 15 bp, Homo sapiens
atgtgagtttattct

SEQ ID NO: 45367 - DNA, 15 bp, Homo sapiens
tgtgagtttattctt

SEQ ID NO: 45368 - DNA, 15 bp, Homo sapiens
gtgagtttattcttc

SEQ ID NO: 45369 - DNA, 15 bp, Homo sapiens
tgagtttattcttcc

SEQ ID NO: 45370 - DNA, 15 bp, Homo sapiens
gagtttattcttccc

SEQ ID NO: 45371 - DNA, 15 bp, Homo sapiens
agtttattcttccca

SEQ ID NO: 45372 - DNA, 15 bp, Homo sapiens
gtttattcttcccaa

SEQ ID NO: 45373 - DNA, 15 bp, Homo sapiens
tttattcttcccaag

SEQ ID NO: 45374 - DNA, 15 bp, Homo sapiens
ttattcttcccaagc

SEQ ID NO: 45375 - DNA, 15 bp, Homo sapiens
tattcttcccaagct

SEQ ID NO: 45376 - DNA, 15 bp, Homo sapiens
attcttcccaagctt

SEQ ID NO: 45377 - DNA, 15 bp, Homo sapiens
ttcttcccaagcttt

SEQ ID NO: 45378 - DNA, 15 bp, Homo sapiens
tcttcccaagctttt

SEQ ID NO: 45379 - DNA, 15 bp, Homo sapiens
cttcccaagcttttg

SEQ ID NO: 45380 - DNA, 15 bp, Homo sapiens
ttcccaagcttttgt

SEQ ID NO: 45381 - DNA, 15 bp, Homo sapiens
tcccaagcttttgtg

SEQ ID NO: 45382 - DNA, 15 bp, Homo sapiens
cccaagcttttgtgc

SEQ ID NO: 45383 - DNA, 15 bp, Homo sapiens
ccaagcttttgtgct

SEQ ID NO: 45384 - DNA, 15 bp, Homo sapiens
caagcttttgtgctt

SEQ ID NO: 45385 - DNA, 15 bp, Homo sapiens
aagcttttgtgctta

SEQ ID NO: 45386 - DNA, 15 bp, Homo sapiens
agcttttgtgcttag

SEQ ID NO: 45387 - DNA, 15 bp, Homo sapiens
gcttttgtgcttagc

SEQ ID NO: 45388 - DNA, 15 bp, Homo sapiens
cttttgtgcttagct

SEQ ID NO: 45389 - DNA, 15 bp, Homo sapiens
ttttgtgcttagctc

SEQ ID NO: 45390 - DNA, 15 bp, Homo sapiens
tttgtgcttagctct

SEQ ID NO: 45391 - DNA, 15 bp, Homo sapiens
ttgtgcttagctcta

SEQ ID NO: 45392 - DNA, 15 bp, Homo sapiens
tgtgcttagctctaa

SEQ ID NO: 45393 - DNA, 15 bp, Homo sapiens
gtgcttagctctaag

SEQ ID NO: 45394 - DNA, 15 bp, Homo sapiens
tgcttagctctaagg

SEQ ID NO: 45395 - DNA, 15 bp, Homo sapiens
gcttagctctaaggc

SEQ ID NO: 45396 - DNA, 15 bp, Homo sapiens
cttagctctaaggca

SEQ ID NO: 45397 - DNA, 15 bp, Homo sapiens
ttagctctaaggcag

SEQ ID NO: 45398 - DNA, 15 bp, Homo sapiens
tagctctaaggcagg

SEQ ID NO: 45399 - DNA, 15 bp, Homo sapiens
agctctaaggcagga

SEQ ID NO: 45400 - DNA, 15 bp, Homo sapiens
gctctaaggcaggac

SEQ ID NO: 45401 - DNA, 15 bp, Homo sapiens
ctctaaggcaggact

SEQ ID NO: 45402 - DNA, 15 bp, Homo sapiens
tctaaggcaggacta

SEQ ID NO: 45403 - DNA, 15 bp, Homo sapiens
ctaaggcaggactac

SEQ ID NO: 45404 - DNA, 15 bp, Homo sapiens
taaggcaggactacc

SEQ ID NO: 45405 - DNA, 15 bp, Homo sapiens
aaggcaggactacct

SEQ ID NO: 45406 - DNA, 15 bp, Homo sapiens
aggcaggactaccta

SEQ ID NO: 45407 - DNA, 15 bp, Homo sapiens
ggcaggactacctaa

SEQ ID NO: 45408 - DNA, 15 bp, Homo sapiens
gcaggactacctaat

SEQ ID NO: 45409 - DNA, 15 bp, Homo sapiens
caggactacctaata

SEQ ID NO: 45410 - DNA, 15 bp, Homo sapiens
aggactacctaatac

SEQ ID NO: 45411 - DNA, 15 bp, Homo sapiens
ggactacctaatacc

SEQ ID NO: 45412 - DNA, 15 bp, Homo sapiens
gactacctaatacca

SEQ ID NO: 45413 - DNA, 15 bp, Homo sapiens
actacctaataccac

SEQ ID NO: 45414 - DNA, 15 bp, Homo sapiens
ctacctaataccact

SEQ ID NO: 45415 - DNA, 15 bp, Homo sapiens
tacctaataccactc

SEQ ID NO: 45416 - DNA, 15 bp, Homo sapiens
acctaataccactct

SEQ ID NO: 45417 - DNA, 15 bp, Homo sapiens
cctaataccactctc

SEQ ID NO: 45418 - DNA, 15 bp, Homo sapiens
ctaataccactctca

SEQ ID NO: 45419 - DNA, 15 bp, Homo sapiens
taataccactctcac

SEQ ID NO: 45420 - DNA, 15 bp, Homo sapiens
aataccactctcaca

SEQ ID NO: 45421 - DNA, 15 bp, Homo sapiens
ataccactctcacag

SEQ ID NO: 45422 - DNA, 15 bp, Homo sapiens
taccactctcacagc

SEQ ID NO: 45423 - DNA, 15 bp, Homo sapiens
accactctcacagcc

SEQ ID NO: 45424 - DNA, 15 bp, Homo sapiens
ccactctcacagcca

SEQ ID NO: 45425 - DNA, 15 bp, Homo sapiens
cactctcacagccag

SEQ ID NO: 45426 - DNA, 15 bp, Homo sapiens
actctcacagccagc

SEQ ID NO: 45427 - DNA, 15 bp, Homo sapiens
ctctcacagccagcc

SEQ ID NO: 45428 - DNA, 15 bp, Homo sapiens
tctcacagccagcca

SEQ ID NO: 45429 - DNA, 15 bp, Homo sapiens
ctcacagccagccat

SEQ ID NO: 45430 - DNA, 15 bp, Homo sapiens
tcacagccagccatt

SEQ ID NO: 45431 - DNA, 15 bp, Homo sapiens
cacagccagccattt

SEQ ID NO: 45432 - DNA, 15 bp, Homo sapiens
acagccagccatttg

SEQ ID NO: 45433 - DNA, 15 bp, Homo sapiens
cagccagccatttga

SEQ ID NO: 45434 - DNA, 15 bp, Homo sapiens
agccagccatttgaa

SEQ ID NO: 45435 - DNA, 15 bp, Homo sapiens
gccagccatttgaaa

SEQ ID NO: 45436 - DNA, 15 bp, Homo sapiens
ccagccatttgaaat

SEQ ID NO: 45437 - DNA, 15 bp, Homo sapiens
cagccatttgaaatt

SEQ ID NO: 45438 - DNA, 15 bp, Homo sapiens
agccatttgaaattt

SEQ ID NO: 45439 - DNA, 15 bp, Homo sapiens
gccatttgaaatttg

SEQ ID NO: 45440 - DNA, 15 bp, Homo sapiens
ccatttgaaatttgg

SEQ ID NO: 45441 - DNA, 15 bp, Homo sapiens
catttgaaatttggg

SEQ ID NO: 45442 - DNA, 15 bp, Homo sapiens
atttgaaatttggga

SEQ ID NO: 45443 - DNA, 15 bp, Homo sapiens
tttgaaatttgggat

SEQ ID NO: 45444 - DNA, 15 bp, Homo sapiens
ttgaaatttgggatt

SEQ ID NO: 45445 - DNA, 15 bp, Homo sapiens
tgaaatttgggattc

SEQ ID NO: 45446 - DNA, 15 bp, Homo sapiens
gaaatttgggattct

SEQ ID NO: 45447 - DNA, 15 bp, Homo sapiens
aaatttgggattctg

SEQ ID NO: 45448 - DNA, 15 bp, Homo sapiens
aatttgggattctga

SEQ ID NO: 45449 - DNA, 15 bp, Homo sapiens
atttgggattctgag

SEQ ID NO: 45450 - DNA, 15 bp, Homo sapiens
tttgggattctgagc

SEQ ID NO: 45451 - DNA, 15 bp, Homo sapiens
ttgggattctgagca

SEQ ID NO: 45452 - DNA, 15 bp, Homo sapiens
tgggattctgagcaa

SEQ ID NO: 45453 - DNA, 15 bp, Homo sapiens
gggattctgagcaat

SEQ ID NO: 45454 - DNA, 15 bp, Homo sapiens
ggattctgagcaatc

SEQ ID NO: 45455 - DNA, 15 bp, Homo sapiens
gattctgagcaatct

SEQ ID NO: 45456 - DNA, 15 bp, Homo sapiens
attctgagcaatcta

SEQ ID NO: 45457 - DNA, 15 bp, Homo sapiens
ttctgagcaatctaa

SEQ ID NO: 45458 - DNA, 15 bp, Homo sapiens
tctgagcaatctaaa

SEQ ID NO: 45459 - DNA, 15 bp, Homo sapiens
ctgagcaatctaaag

SEQ ID NO: 45460 - DNA, 15 bp, Homo sapiens
tgagcaatctaaaga

SEQ ID NO: 45461 - DNA, 15 bp, Homo sapiens
gagcaatctaaagag

SEQ ID NO: 45462 - DNA, 15 bp, Homo sapiens
agcaatctaaagagt

SEQ ID NO: 45463 - DNA, 15 bp, Homo sapiens
gcaatctaaagagta

SEQ ID NO: 45464 - DNA, 15 bp, Homo sapiens
caatctaaagagtaa

SEQ ID NO: 45465 - DNA, 15 bp, Homo sapiens
aatctaaagagtaac

SEQ ID NO: 45466 - DNA, 15 bp, Homo sapiens
atctaaagagtaact

SEQ ID NO: 45467 - DNA, 15 bp, Homo sapiens
tctaaagagtaactt

SEQ ID NO: 45468 - DNA, 15 bp, Homo sapiens
ctaaagagtaacttg

SEQ ID NO: 45469 - DNA, 15 bp, Homo sapiens
taaagagtaacttgt

SEQ ID NO: 45470 - DNA, 15 bp, Homo sapiens
aaagagtaacttgtc

SEQ ID NO: 45471 - DNA, 15 bp, Homo sapiens
aagagtaacttgtct

SEQ ID NO: 45472 - DNA, 15 bp, Homo sapiens
agagtaacttgtctc

SEQ ID NO: 45473 - DNA, 15 bp, Homo sapiens
gagtaacttgtctct

SEQ ID NO: 45474 - DNA, 15 bp, Homo sapiens
agtaacttgtctctg

SEQ ID NO: 45475 - DNA, 15 bp, Homo sapiens
gtaacttgtctctgg

SEQ ID NO: 45476 - DNA, 15 bp, Homo sapiens
taacttgtctctgga

SEQ ID NO: 45477 - DNA, 15 bp, Homo sapiens
aacttgtctctggaa

SEQ ID NO: 45478 - DNA, 15 bp, Homo sapiens
acttgtctctggaac

SEQ ID NO: 45479 - DNA, 15 bp, Homo sapiens
cttgtctctggaact

SEQ ID NO: 45480 - DNA, 15 bp, Homo sapiens
ttgtctctggaactg

SEQ ID NO: 45481 - DNA, 15 bp, Homo sapiens
tgtctctggaactga

SEQ ID NO: 45482 - DNA, 15 bp, Homo sapiens
gtctctggaactgac

SEQ ID NO: 45483 - DNA, 15 bp, Homo sapiens
tctctggaactgacc

SEQ ID NO: 45484 - DNA, 15 bp, Homo sapiens
ctctggaactgacct

SEQ ID NO: 45485 - DNA, 15 bp, Homo sapiens
tctggaactgacctt

SEQ ID NO: 45486 - DNA, 15 bp, Homo sapiens
ctggaactgaccttt

SEQ ID NO: 45487 - DNA, 15 bp, Homo sapiens
tggaactgacctttt

SEQ ID NO: 45488 - DNA, 15 bp, Homo sapiens
ggaactgaccttttg

SEQ ID NO: 45489 - DNA, 15 bp, Homo sapiens
gaactgaccttttgc

SEQ ID NO: 45490 - DNA, 15 bp, Homo sapiens
aactgaccttttgct

SEQ ID NO: 45491 - DNA, 15 bp, Homo sapiens
actgaccttttgctg

SEQ ID NO: 45492 - DNA, 15 bp, Homo sapiens
ctgaccttttgctga

SEQ ID NO: 45493 - DNA, 15 bp, Homo sapiens
tgaccttttgctgac

SEQ ID NO: 45494 - DNA, 15 bp, Homo sapiens
gaccttttgctgacc

SEQ ID NO: 45495 - DNA, 15 bp, Homo sapiens
accttttgctgaccg

SEQ ID NO: 45496 - DNA, 15 bp, Homo sapiens
ccttttgctgaccgg

SEQ ID NO: 45497 - DNA, 15 bp, Homo sapiens
cttttgctgaccggg

SEQ ID NO: 45498 - DNA, 15 bp, Homo sapiens
ttttgctgaccggga

SEQ ID NO: 45499 - DNA, 15 bp, Homo sapiens
tttgctgaccgggag

SEQ ID NO: 45500 - DNA, 15 bp, Homo sapiens
ttgctgaccgggagt

SEQ ID NO: 45501 - DNA, 15 bp, Homo sapiens
tgctgaccgggagtc

SEQ ID NO: 45502 - DNA, 15 bp, Homo sapiens
gctgaccgggagtcc

SEQ ID NO: 45503 - DNA, 15 bp, Homo sapiens
ctgaccgggagtcct

SEQ ID NO: 45504 - DNA, 15 bp, Homo sapiens
tgaccgggagtcctc

SEQ ID NO: 45505 - DNA, 15 bp, Homo sapiens
gaccgggagtcctca

SEQ ID NO: 45506 - DNA, 15 bp, Homo sapiens
accgggagtcctcat

SEQ ID NO: 45507 - DNA, 15 bp, Homo sapiens
ccgggagtcctcata

SEQ ID NO: 45508 - DNA, 15 bp, Homo sapiens
cgggagtcctcataa

SEQ ID NO: 45509 - DNA, 15 bp, Homo sapiens
gggagtcctcataac

SEQ ID NO: 45510 - DNA, 15 bp, Homo sapiens
ggagtcctcataact

SEQ ID NO: 45511 - DNA, 15 bp, Homo sapiens
gagtcctcataactt

SEQ ID NO: 45512 - DNA, 15 bp, Homo sapiens
agtcctcataacttg

SEQ ID NO: 45513 - DNA, 15 bp, Homo sapiens
gtcctcataacttgg

SEQ ID NO: 45514 - DNA, 15 bp, Homo sapiens
tcctcataacttgga

SEQ ID NO: 45515 - DNA, 15 bp, Homo sapiens
cctcataacttggat

SEQ ID NO: 45516 - DNA, 15 bp, Homo sapiens
ctcataacttggatt

SEQ ID NO: 45517 - DNA, 15 bp, Homo sapiens
tcataacttggattt

SEQ ID NO: 45518 - DNA, 15 bp, Homo sapiens
cataacttggatttt

SEQ ID NO: 45519 - DNA, 15 bp, Homo sapiens
ataacttggattttg

SEQ ID NO: 45520 - DNA, 15 bp, Homo sapiens
taacttggattttgt

SEQ ID NO: 45521 - DNA, 15 bp, Homo sapiens
aacttggattttgtg

SEQ ID NO: 45522 - DNA, 15 bp, Homo sapiens
acttggattttgtgt

SEQ ID NO: 45523 - DNA, 15 bp, Homo sapiens
cttggattttgtgtg

SEQ ID NO: 45524 - DNA, 15 bp, Homo sapiens
ttggattttgtgtgg

SEQ ID NO: 45525 - DNA, 15 bp, Homo sapiens
tggattttgtgtggg

SEQ ID NO: 45526 - DNA, 15 bp, Homo sapiens
ggattttgtgtgggt

SEQ ID NO: 45527 - DNA, 15 bp, Homo sapiens
gattttgtgtgggtt

SEQ ID NO: 45528 - DNA, 15 bp, Homo sapiens
attttgtgtgggttg

SEQ ID NO: 45529 - DNA, 15 bp, Homo sapiens
ttttgtgtgggttgt

SEQ ID NO: 45530 - DNA, 15 bp, Homo sapiens
tttgtgtgggttgtt

SEQ ID NO: 45531 - DNA, 15 bp, Homo sapiens
ttgtgtgggttgttg

SEQ ID NO: 45532 - DNA, 15 bp, Homo sapiens
tgtgtgggttgttgt

SEQ ID NO: 45533 - DNA, 15 bp, Homo sapiens
gtgtgggttgttgtg

SEQ ID NO: 45534 - DNA, 15 bp, Homo sapiens
tgtgggttgttgtgt

SEQ ID NO: 45535 - DNA, 15 bp, Homo sapiens
gtgggttgttgtgtc

SEQ ID NO: 45536 - DNA, 15 bp, Homo sapiens
tgggttgttgtgtct

SEQ ID NO: 45537 - DNA, 15 bp, Homo sapiens
gggttgttgtgtctt

SEQ ID NO: 45538 - DNA, 15 bp, Homo sapiens
ggttgttgtgtcttt

SEQ ID NO: 45539 - DNA, 15 bp, Homo sapiens
gttgttgtgtctttg

SEQ ID NO: 45540 - DNA, 15 bp, Homo sapiens
ttgttgtgtctttgg

SEQ ID NO: 45541 - DNA, 15 bp, Homo sapiens
tgttgtgtctttggt

SEQ ID NO: 45542 - DNA, 15 bp, Homo sapiens
gttgtgtctttggtg

SEQ ID NO: 45543 - DNA, 15 bp, Homo sapiens
ttgtgtctttggtgc

SEQ ID NO: 45544 - DNA, 15 bp, Homo sapiens
tgtgtctttggtgcc

SEQ ID NO: 45545 - DNA, 15 bp, Homo sapiens
gtgtctttggtgcca

SEQ ID NO: 45546 - DNA, 15 bp, Homo sapiens
tgtctttggtgccac

SEQ ID NO: 45547 - DNA, 15 bp, Homo sapiens
gtctttggtgccact

SEQ ID NO: 45548 - DNA, 15 bp, Homo sapiens
tctttggtgccactg

SEQ ID NO: 45549 - DNA, 15 bp, Homo sapiens
ctttggtgccactgc

SEQ ID NO: 45550 - DNA, 15 bp, Homo sapiens
tttggtgccactgct

SEQ ID NO: 45551 - DNA, 15 bp, Homo sapiens
ttggtgccactgctg

SEQ ID NO: 45552 - DNA, 15 bp, Homo sapiens
tggtgccactgctgc

SEQ ID NO: 45553 - DNA, 15 bp, Homo sapiens
ggtgccactgctgct

SEQ ID NO: 45554 - DNA, 15 bp, Homo sapiens
gtgccactgctgctc

SEQ ID NO: 45555 - DNA, 15 bp, Homo sapiens
tgccactgctgctca

SEQ ID NO: 45556 - DNA, 15 bp, Homo sapiens
gccactgctgctcat

SEQ ID NO: 45557 - DNA, 15 bp, Homo sapiens
ccactgctgctcatt

SEQ ID NO: 45558 - DNA, 15 bp, Homo sapiens
cactgctgctcattc

SEQ ID NO: 45559 - DNA, 15 bp, Homo sapiens
actgctgctcattca

SEQ ID NO: 45560 - DNA, 15 bp, Homo sapiens
ctgctgctcattcat

SEQ ID NO: 45561 - DNA, 15 bp, Homo sapiens
tgctgctcattcatt

SEQ ID NO: 45562 - DNA, 15 bp, Homo sapiens
gctgctcattcattc

SEQ ID NO: 45563 - DNA, 15 bp, Homo sapiens
ctgctcattcattca

SEQ ID NO: 45564 - DNA, 15 bp, Homo sapiens
tgctcattcattcag

SEQ ID NO: 45565 - DNA, 15 bp, Homo sapiens
gctcattcattcagc

SEQ ID NO: 45566 - DNA, 15 bp, Homo sapiens
ctcattcattcagca

SEQ ID NO: 45567 - DNA, 15 bp, Homo sapiens
tcattcattcagcac

SEQ ID NO: 45568 - DNA, 15 bp, Homo sapiens
cattcattcagcacc

SEQ ID NO: 45569 - DNA, 15 bp, Homo sapiens
attcattcagcacct

SEQ ID NO: 45570 - DNA, 15 bp, Homo sapiens
ttcattcagcacctc

SEQ ID NO: 45571 - DNA, 15 bp, Homo sapiens
tcattcagcacctca

SEQ ID NO: 45572 - DNA, 15 bp, Homo sapiens
cattcagcacctcag

SEQ ID NO: 45573 - DNA, 15 bp, Homo sapiens
attcagcacctcagt

SEQ ID NO: 45574 - DNA, 15 bp, Homo sapiens
ttcagcacctcagtg

SEQ ID NO: 45575 - DNA, 15 bp, Homo sapiens
tcagcacctcagtga

SEQ ID NO: 45576 - DNA, 15 bp, Homo sapiens
cagcacctcagtgat

SEQ ID NO: 45577 - DNA, 15 bp, Homo sapiens
agcacctcagtgatg

SEQ ID NO: 45578 - DNA, 15 bp, Homo sapiens
gcacctcagtgatgc

SEQ ID NO: 45579 - DNA, 15 bp, Homo sapiens
cacctcagtgatgct

SEQ ID NO: 45580 - DNA, 15 bp, Homo sapiens
acctcagtgatgctg

SEQ ID NO: 45581 - DNA, 15 bp, Homo sapiens
cctcagtgatgctgt

SEQ ID NO: 45582 - DNA, 15 bp, Homo sapiens
ctcagtgatgctgtt

SEQ ID NO: 45583 - DNA, 15 bp, Homo sapiens
tcagtgatgctgttt

SEQ ID NO: 45584 - DNA, 15 bp, Homo sapiens
cagtgatgctgtttt

SEQ ID NO: 45585 - DNA, 15 bp, Homo sapiens
agtgatgctgttttt

SEQ ID NO: 45586 - DNA, 15 bp, Homo sapiens
gtgatgctgtttttc

SEQ ID NO: 45587 - DNA, 15 bp, Homo sapiens
tgatgctgtttttca

SEQ ID NO: 45588 - DNA, 15 bp, Homo sapiens
gatgctgtttttcat

SEQ ID NO: 45589 - DNA, 15 bp, Homo sapiens
atgctgtttttcata

SEQ ID NO: 45590 - DNA, 15 bp, Homo sapiens
tgctgtttttcatac

SEQ ID NO: 45591 - DNA, 15 bp, Homo sapiens
gctgtttttcatact

SEQ ID NO: 45592 - DNA, 15 bp, Homo sapiens
ctgtttttcatactg

SEQ ID NO: 45593 - DNA, 15 bp, Homo sapiens
tgtttttcatactgt

SEQ ID NO: 45594 - DNA, 15 bp, Homo sapiens
gtttttcatactgtt

SEQ ID NO: 45595 - DNA, 15 bp, Homo sapiens
tttttcatactgttc

SEQ ID NO: 45596 - DNA, 15 bp, Homo sapiens
ttttcatactgttcg

SEQ ID NO: 45597 - DNA, 15 bp, Homo sapiens
tttcatactgttcga

SEQ ID NO: 45598 - DNA, 15 bp, Homo sapiens
ttcatactgttcgat

SEQ ID NO: 45599 - DNA, 15 bp, Homo sapiens
tcatactgttcgatt

SEQ ID NO: 45600 - DNA, 15 bp, Homo sapiens
catactgttcgattg

SEQ ID NO: 45601 - DNA, 15 bp, Homo sapiens
atactgttcgattgg

SEQ ID NO: 45602 - DNA, 15 bp, Homo sapiens
tactgttcgattggt

SEQ ID NO: 45603 - DNA, 15 bp, Homo sapiens
actgttcgattggtc

SEQ ID NO: 45604 - DNA, 15 bp, Homo sapiens
ctgttcgattggtcg

SEQ ID NO: 45605 - DNA, 15 bp, Homo sapiens
tgttcgattggtcgg

SEQ ID NO: 45606 - DNA, 15 bp, Homo sapiens
gttcgattggtcggg

SEQ ID NO: 45607 - DNA, 15 bp, Homo sapiens
ttcgattggtcgggg

SEQ ID NO: 45608 - DNA, 15 bp, Homo sapiens
tcgattggtcggggg

SEQ ID NO: 45609 - DNA, 15 bp, Homo sapiens
cgattggtcgggggt

SEQ ID NO: 45610 - DNA, 15 bp, Homo sapiens
gattggtcgggggtg

SEQ ID NO: 45611 - DNA, 15 bp, Homo sapiens
attggtcgggggtgt

SEQ ID NO: 45612 - DNA, 15 bp, Homo sapiens
ttggtcgggggtgtg

SEQ ID NO: 45613 - DNA, 15 bp, Homo sapiens
tggtcgggggtgtga

SEQ ID NO: 45614 - DNA, 15 bp, Homo sapiens
ggtcgggggtgtgat

SEQ ID NO: 45615 - DNA, 15 bp, Homo sapiens
gtcgggggtgtgatg

SEQ ID NO: 45616 - DNA, 15 bp, Homo sapiens
tcgggggtgtgatgg

SEQ ID NO: 45617 - DNA, 15 bp, Homo sapiens
cgggggtgtgatggg

SEQ ID NO: 45618 - DNA, 15 bp, Homo sapiens
gggggtgtgatgggc

SEQ ID NO: 45619 - DNA, 15 bp, Homo sapiens
ggggtgtgatgggcg

SEQ ID NO: 45620 - DNA, 15 bp, Homo sapiens
gggtgtgatgggcga

SEQ ID NO: 45621 - DNA, 15 bp, Homo sapiens
ggtgtgatgggcgaa

SEQ ID NO: 45622 - DNA, 15 bp, Homo sapiens
gtgtgatgggcgaag

SEQ ID NO: 45623 - DNA, 15 bp, Homo sapiens
tgtgatgggcgaagc

SEQ ID NO: 45624 - DNA, 15 bp, Homo sapiens
gtgatgggcgaagca

SEQ ID NO: 45625 - DNA, 15 bp, Homo sapiens
tgatgggcgaagcag

SEQ ID NO: 45626 - DNA, 15 bp, Homo sapiens
gatgggcgaagcagt

SEQ ID NO: 45627 - DNA, 15 bp, Homo sapiens
atgggcgaagcagtc

SEQ ID NO: 45628 - DNA, 15 bp, Homo sapiens
tgggcgaagcagtct

SEQ ID NO: 45629 - DNA, 15 bp, Homo sapiens
gggcgaagcagtcta

SEQ ID NO: 45630 - DNA, 15 bp, Homo sapiens
ggcgaagcagtctaa

SEQ ID NO: 45631 - DNA, 15 bp, Homo sapiens
gcgaagcagtctaat

SEQ ID NO: 45632 - DNA, 15 bp, Homo sapiens
cgaagcagtctaata

SEQ ID NO: 45633 - DNA, 15 bp, Homo sapiens
gaagcagtctaatat

SEQ ID NO: 45634 - DNA, 15 bp, Homo sapiens
aagcagtctaatata

SEQ ID NO: 45635 - DNA, 15 bp, Homo sapiens
agcagtctaatataa

SEQ ID NO: 45636 - DNA, 15 bp, Homo sapiens
gcagtctaatataat

SEQ ID NO: 45637 - DNA, 15 bp, Homo sapiens
cagtctaatataatt

SEQ ID NO: 45638 - DNA, 15 bp, Homo sapiens
agtctaatataatta

SEQ ID NO: 45639 - DNA, 15 bp, Homo sapiens
gtctaatataattaa

SEQ ID NO: 45640 - DNA, 15 bp, Homo sapiens
tctaatataattaag

SEQ ID NO: 45641 - DNA, 15 bp, Homo sapiens
ctaatataattaagc

SEQ ID NO: 45642 - DNA, 15 bp, Homo sapiens
taatataattaagct

SEQ ID NO: 45643 - DNA, 15 bp, Homo sapiens
aatataattaagcta

SEQ ID NO: 45644 - DNA, 15 bp, Homo sapiens
atataattaagctag

SEQ ID NO: 45645 - DNA, 15 bp, Homo sapiens
tataattaagctagt

SEQ ID NO: 45646 - DNA, 15 bp, Homo sapiens
ataattaagctagtt

SEQ ID NO: 45647 - DNA, 15 bp, Homo sapiens
taattaagctagtta

SEQ ID NO: 45648 - DNA, 15 bp, Homo sapiens
aattaagctagttag

SEQ ID NO: 45649 - DNA, 15 bp, Homo sapiens
attaagctagttagg

SEQ ID NO: 45650 - DNA, 15 bp, Homo sapiens
ttaagctagttaggg

SEQ ID NO: 45651 - DNA, 15 bp, Homo sapiens
taagctagttagggt

SEQ ID NO: 45652 - DNA, 15 bp, Homo sapiens
aagctagttagggta

SEQ ID NO: 45653 - DNA, 15 bp, Homo sapiens
agctagttagggtaa

SEQ ID NO: 45654 - DNA, 15 bp, Homo sapiens
gctagttagggtaag

SEQ ID NO: 45655 - DNA, 15 bp, Homo sapiens
ctagttagggtaagg

SEQ ID NO: 45656 - DNA, 15 bp, Homo sapiens
tagttagggtaaggg

SEQ ID NO: 45657 - DNA, 15 bp, Homo sapiens
agttagggtaaggga

SEQ ID NO: 45658 - DNA, 15 bp, Homo sapiens
gttagggtaagggac

SEQ ID NO: 45659 - DNA, 15 bp, Homo sapiens
ttagggtaagggaca

SEQ ID NO: 45660 - DNA, 15 bp, Homo sapiens
tagggtaagggacag

SEQ ID NO: 45661 - DNA, 15 bp, Homo sapiens
agggtaagggacagt

SEQ ID NO: 45662 - DNA, 15 bp, Homo sapiens
gggtaagggacagta

SEQ ID NO: 45663 - DNA, 15 bp, Homo sapiens
ggtaagggacagtac

SEQ ID NO: 45664 - DNA, 15 bp, Homo sapiens
gtaagggacagtact

SEQ ID NO: 45665 - DNA, 15 bp, Homo sapiens
taagggacagtactg

SEQ ID NO: 45666 - DNA, 15 bp, Homo sapiens
aagggacagtactgc

SEQ ID NO: 45667 - DNA, 15 bp, Homo sapiens
agggacagtactgct

SEQ ID NO: 45668 - DNA, 15 bp, Homo sapiens
gggacagtactgctg

SEQ ID NO: 45669 - DNA, 15 bp, Homo sapiens
ggacagtactgctga

SEQ ID NO: 45670 - DNA, 15 bp, Homo sapiens
gacagtactgctgat

SEQ ID NO: 45671 - DNA, 15 bp, Homo sapiens
acagtactgctgatg

SEQ ID NO: 45672 - DNA, 15 bp, Homo sapiens
cagtactgctgatgc

SEQ ID NO: 45673 - DNA, 15 bp, Homo sapiens
agtactgctgatgct

SEQ ID NO: 45674 - DNA, 15 bp, Homo sapiens
gtactgctgatgctg

SEQ ID NO: 45675 - DNA, 15 bp, Homo sapiens
tactgctgatgctga

SEQ ID NO: 45676 - DNA, 15 bp, Homo sapiens
actgctgatgctgag

SEQ ID NO: 45677 - DNA, 15 bp, Homo sapiens
ctgctgatgctgagt

SEQ ID NO: 45678 - DNA, 15 bp, Homo sapiens
tgctgatgctgagtg

SEQ ID NO: 45679 - DNA, 15 bp, Homo sapiens
gctgatgctgagtga

SEQ ID NO: 45680 - DNA, 15 bp, Homo sapiens
ctgatgctgagtgag

SEQ ID NO: 45681 - DNA, 15 bp, Homo sapiens
tgatgctgagtgagc

SEQ ID NO: 45682 - DNA, 15 bp, Homo sapiens
gatgctgagtgagcc

SEQ ID NO: 45683 - DNA, 15 bp, Homo sapiens
atgctgagtgagcct

SEQ ID NO: 45684 - DNA, 15 bp, Homo sapiens
tgctgagtgagcctc

SEQ ID NO: 45685 - DNA, 15 bp, Homo sapiens
gctgagtgagcctca

SEQ ID NO: 45686 - DNA, 15 bp, Homo sapiens
ctgagtgagcctcag

SEQ ID NO: 45687 - DNA, 15 bp, Homo sapiens
tgagtgagcctcagt

SEQ ID NO: 45688 - DNA, 15 bp, Homo sapiens
gagtgagcctcagtg

SEQ ID NO: 45689 - DNA, 15 bp, Homo sapiens
agtgagcctcagtga

SEQ ID NO: 45690 - DNA, 15 bp, Homo sapiens
gtgagcctcagtgag

SEQ ID NO: 45691 - DNA, 15 bp, Homo sapiens
tgagcctcagtgagt

SEQ ID NO: 45692 - DNA, 15 bp, Homo sapiens
gagcctcagtgagtt

SEQ ID NO: 45693 - DNA, 15 bp, Homo sapiens
agcctcagtgagttt

SEQ ID NO: 45694 - DNA, 15 bp, Homo sapiens
gcctcagtgagtttt

SEQ ID NO: 45695 - DNA, 15 bp, Homo sapiens
cctcagtgagtttta

SEQ ID NO: 45696 - DNA, 15 bp, Homo sapiens
ctcagtgagttttat

SEQ ID NO: 45697 - DNA, 15 bp, Homo sapiens
tcagtgagttttatt

SEQ ID NO: 45698 - DNA, 15 bp, Homo sapiens
cagtgagttttatta

SEQ ID NO: 45699 - DNA, 15 bp, Homo sapiens
agtgagttttattaa

SEQ ID NO: 45700 - DNA, 15 bp, Homo sapiens
gtgagttttattaaa

SEQ ID NO: 45701 - DNA, 15 bp, Homo sapiens
tgagttttattaaag

SEQ ID NO: 45702 - DNA, 15 bp, Homo sapiens
gagttttattaaagt

SEQ ID NO: 45703 - DNA, 15 bp, Homo sapiens
agttttattaaagtt

SEQ ID NO: 45704 - DNA, 15 bp, Homo sapiens
gttttattaaagttg

SEQ ID NO: 45705 - DNA, 15 bp, Homo sapiens
ttttattaaagttgt

SEQ ID NO: 45706 - DNA, 15 bp, Homo sapiens
tttattaaagttgtt

SEQ ID NO: 45707 - DNA, 15 bp, Homo sapiens
ttattaaagttgttt

SEQ ID NO: 45708 - DNA, 15 bp, Homo sapiens
tattaaagttgtttt

SEQ ID NO: 45709 - DNA, 15 bp, Homo sapiens
attaaagttgttttc

SEQ ID NO: 45710 - DNA, 15 bp, Homo sapiens
ttaaagttgttttcg

SEQ ID NO: 45711 - DNA, 15 bp, Homo sapiens
taaagttgttttcgt

SEQ ID NO: 45712 - DNA, 15 bp, Homo sapiens
aaagttgttttcgta

SEQ ID NO: 45713 - DNA, 15 bp, Homo sapiens
aagttgttttcgtaa

SEQ ID NO: 45714 - DNA, 15 bp, Homo sapiens
agttgttttcgtaaa

SEQ ID NO: 45715 - DNA, 15 bp, Homo sapiens
gttgttttcgtaaat

SEQ ID NO: 45716 - DNA, 15 bp, Homo sapiens
ttgttttcgtaaatg

SEQ ID NO: 45717 - DNA, 15 bp, Homo sapiens
tgttttcgtaaatga

SEQ ID NO: 45718 - DNA, 15 bp, Homo sapiens
gttttcgtaaatgaa

SEQ ID NO: 45719 - DNA, 15 bp, Homo sapiens
ttttcgtaaatgaaa

SEQ ID NO: 45720 - DNA, 15 bp, Homo sapiens
tttcgtaaatgaaag

SEQ ID NO: 45721 - DNA, 15 bp, Homo sapiens
ttcgtaaatgaaaga

SEQ ID NO: 45722 - DNA, 15 bp, Homo sapiens
tcgtaaatgaaagag

SEQ ID NO: 45723 - DNA, 15 bp, Homo sapiens
cgtaaatgaaagagg

SEQ ID NO: 45724 - DNA, 15 bp, Homo sapiens
gtaaatgaaagaggt

SEQ ID NO: 45725 - DNA, 15 bp, Homo sapiens
taaatgaaagaggtt

SEQ ID NO: 45726 - DNA, 15 bp, Homo sapiens
aaatgaaagaggttg

SEQ ID NO: 45727 - DNA, 15 bp, Homo sapiens
aatgaaagaggttgt

SEQ ID NO: 45728 - DNA, 15 bp, Homo sapiens
atgaaagaggttgtt

SEQ ID NO: 45729 - DNA, 15 bp, Homo sapiens
tgaaagaggttgttt

SEQ ID NO: 45730 - DNA, 15 bp, Homo sapiens
gaaagaggttgtttg

SEQ ID NO: 45731 - DNA, 15 bp, Homo sapiens
aaagaggttgtttgc

SEQ ID NO: 45732 - DNA, 15 bp, Homo sapiens
aagaggttgtttgcc

SEQ ID NO: 45733 - DNA, 15 bp, Homo sapiens
agaggttgtttgcct

SEQ ID NO: 45734 - DNA, 15 bp, Homo sapiens
gaggttgtttgcctt

SEQ ID NO: 45735 - DNA, 15 bp, Homo sapiens
aggttgtttgccttt

SEQ ID NO: 45736 - DNA, 15 bp, Homo sapiens
ggttgtttgcctttg

SEQ ID NO: 45737 - DNA, 15 bp, Homo sapiens
gttgtttgcctttgt

SEQ ID NO: 45738 - DNA, 15 bp, Homo sapiens
ttgtttgcctttgtc

SEQ ID NO: 45739 - DNA, 15 bp, Homo sapiens
tgtttgcctttgtcc

SEQ ID NO: 45740 - DNA, 15 bp, Homo sapiens
gtttgcctttgtcct

SEQ ID NO: 45741 - DNA, 15 bp, Homo sapiens
tttgcctttgtccta

SEQ ID NO: 45742 - DNA, 15 bp, Homo sapiens
ttgcctttgtcctaa

SEQ ID NO: 45743 - DNA, 15 bp, Homo sapiens
tgcctttgtcctaag

SEQ ID NO: 45744 - DNA, 15 bp, Homo sapiens
gcctttgtcctaagc

SEQ ID NO: 45745 - DNA, 15 bp, Homo sapiens
cctttgtcctaagct

SEQ ID NO: 45746 - DNA, 15 bp, Homo sapiens
ctttgtcctaagcta

SEQ ID NO: 45747 - DNA, 15 bp, Homo sapiens
tttgtcctaagctaa

SEQ ID NO: 45748 - DNA, 15 bp, Homo sapiens
ttgtcctaagctaac

SEQ ID NO: 45749 - DNA, 15 bp, Homo sapiens
tgtcctaagctaaca

SEQ ID NO: 45750 - DNA, 15 bp, Homo sapiens
gtcctaagctaacaa

SEQ ID NO: 45751 - DNA, 15 bp, Homo sapiens
tcctaagctaacaaa

SEQ ID NO: 45752 - DNA, 15 bp, Homo sapiens
cctaagctaacaaag

SEQ ID NO: 45753 - DNA, 15 bp, Homo sapiens
ctaagctaacaaagg

SEQ ID NO: 45754 - DNA, 15 bp, Homo sapiens
taagctaacaaaggt

SEQ ID NO: 45755 - DNA, 15 bp, Homo sapiens
aagctaacaaaggta

SEQ ID NO: 45756 - DNA, 15 bp, Homo sapiens
agctaacaaaggtag

SEQ ID NO: 45757 - DNA, 15 bp, Homo sapiens
gctaacaaaggtagt

SEQ ID NO: 45758 - DNA, 15 bp, Homo sapiens
ctaacaaaggtagtt

SEQ ID NO: 45759 - DNA, 15 bp, Homo sapiens
taacaaaggtagttt

SEQ ID NO: 45760 - DNA, 15 bp, Homo sapiens
aacaaaggtagttta

SEQ ID NO: 45761 - DNA, 15 bp, Homo sapiens
acaaaggtagtttat

SEQ ID NO: 45762 - DNA, 15 bp, Homo sapiens
caaaggtagtttatt

SEQ ID NO: 45763 - DNA, 15 bp, Homo sapiens
aaaggtagtttattt

SEQ ID NO: 45764 - DNA, 15 bp, Homo sapiens
aaggtagtttatttg

SEQ ID NO: 45765 - DNA, 15 bp, Homo sapiens
aggtagtttatttgt

SEQ ID NO: 45766 - DNA, 15 bp, Homo sapiens
ggtagtttatttgtg

SEQ ID NO: 45767 - DNA, 15 bp, Homo sapiens
gtagtttatttgtgt

SEQ ID NO: 45768 - DNA, 15 bp, Homo sapiens
tagtttatttgtgta

SEQ ID NO: 45769 - DNA, 15 bp, Homo sapiens
agtttatttgtgtag

SEQ ID NO: 45770 - DNA, 15 bp, Homo sapiens
gtttatttgtgtagc

SEQ ID NO: 45771 - DNA, 15 bp, Homo sapiens
tttatttgtgtagca

SEQ ID NO: 45772 - DNA, 15 bp, Homo sapiens
ttatttgtgtagcat

SEQ ID NO: 45773 - DNA, 15 bp, Homo sapiens
tatttgtgtagcatt

SEQ ID NO: 45774 - DNA, 15 bp, Homo sapiens
atttgtgtagcattt

SEQ ID NO: 45775 - DNA, 15 bp, Homo sapiens
tttgtgtagcatttt

SEQ ID NO: 45776 - DNA, 15 bp, Homo sapiens
ttgtgtagcattttt

SEQ ID NO: 45777 - DNA, 15 bp, Homo sapiens
tgtgtagcatttttt

SEQ ID NO: 45778 - DNA, 15 bp, Homo sapiens
gtgtagcatttttta

SEQ ID NO: 45779 - DNA, 15 bp, Homo sapiens
tgtagcattttttaa

SEQ ID NO: 45780 - DNA, 15 bp, Homo sapiens
gtagcattttttaaa

SEQ ID NO: 45781 - DNA, 15 bp, Homo sapiens
tagcattttttaaaa

SEQ ID NO: 45782 - DNA, 15 bp, Homo sapiens
agcattttttaaaaa

SEQ ID NO: 45783 - DNA, 15 bp, Homo sapiens
gcattttttaaaaat

SEQ ID NO: 45784 - DNA, 15 bp, Homo sapiens
cattttttaaaaatc

SEQ ID NO: 45785 - DNA, 15 bp, Homo sapiens
attttttaaaaatcc

SEQ ID NO: 45786 - DNA, 15 bp, Homo sapiens
ttttttaaaaatccc

SEQ ID NO: 45787 - DNA, 15 bp, Homo sapiens
tttttaaaaatccct

SEQ ID NO: 45788 - DNA, 15 bp, Homo sapiens
ttttaaaaatccctt

SEQ ID NO: 45789 - DNA, 15 bp, Homo sapiens
tttaaaaatcccttt

SEQ ID NO: 45790 - DNA, 15 bp, Homo sapiens
ttaaaaatccctttt

SEQ ID NO: 45791 - DNA, 15 bp, Homo sapiens
taaaaatccctttta

SEQ ID NO: 45792 - DNA, 15 bp, Homo sapiens
aaaaatcccttttaa

SEQ ID NO: 45793 - DNA, 15 bp, Homo sapiens
aaaatcccttttaaa

SEQ ID NO: 45794 - DNA, 15 bp, Homo sapiens
aaatcccttttaaat

SEQ ID NO: 45795 - DNA, 15 bp, Homo sapiens
aatcccttttaaata

SEQ ID NO: 45796 - DNA, 15 bp, Homo sapiens
atcccttttaaatac

SEQ ID NO: 45797 - DNA, 15 bp, Homo sapiens
tcccttttaaatact

SEQ ID NO: 45798 - DNA, 15 bp, Homo sapiens
cccttttaaatactc

SEQ ID NO: 45799 - DNA, 15 bp, Homo sapiens
ccttttaaatactct

SEQ ID NO: 45800 - DNA, 15 bp, Homo sapiens
cttttaaatactctg

SEQ ID NO: 45801 - DNA, 15 bp, Homo sapiens
ttttaaatactctga

SEQ ID NO: 45802 - DNA, 15 bp, Homo sapiens
tttaaatactctgat

SEQ ID NO: 45803 - DNA, 15 bp, Homo sapiens
ttaaatactctgatg

SEQ ID NO: 45804 - DNA, 15 bp, Homo sapiens
taaatactctgatgc

SEQ ID NO: 45805 - DNA, 15 bp, Homo sapiens
aaatactctgatgcg

SEQ ID NO: 45806 - DNA, 15 bp, Homo sapiens
aatactctgatgcgc

SEQ ID NO: 45807 - DNA, 15 bp, Homo sapiens
atactctgatgcgct

SEQ ID NO: 45808 - DNA, 15 bp, Homo sapiens
tactctgatgcgctc

SEQ ID NO: 45809 - DNA, 15 bp, Homo sapiens
actctgatgcgctct

SEQ ID NO: 45810 - DNA, 15 bp, Homo sapiens
ctctgatgcgctctc

SEQ ID NO: 45811 - DNA, 15 bp, Homo sapiens
tctgatgcgctctcc

SEQ ID NO: 45812 - DNA, 15 bp, Homo sapiens
ctgatgcgctctccc

SEQ ID NO: 45813 - DNA, 15 bp, Homo sapiens
tgatgcgctctcccc

SEQ ID NO: 45814 - DNA, 15 bp, Homo sapiens
gatgcgctctccccc

SEQ ID NO: 45815 - DNA, 15 bp, Homo sapiens
atgcgctctccccct

SEQ ID NO: 45816 - DNA, 15 bp, Homo sapiens
tgcgctctcccccta

SEQ ID NO: 45817 - DNA, 15 bp, Homo sapiens
gcgctctccccctac

SEQ ID NO: 45818 - DNA, 15 bp, Homo sapiens
cgctctccccctaca

SEQ ID NO: 45819 - DNA, 15 bp, Homo sapiens
gctctccccctacag

SEQ ID NO: 45820 - DNA, 15 bp, Homo sapiens
ctctccccctacaga

SEQ ID NO: 45821 - DNA, 15 bp, Homo sapiens
tctccccctacagat

SEQ ID NO: 45822 - DNA, 15 bp, Homo sapiens
ctccccctacagatg

SEQ ID NO: 45823 - DNA, 15 bp, Homo sapiens
tccccctacagatgt

SEQ ID NO: 45824 - DNA, 15 bp, Homo sapiens
ccccctacagatgtt

SEQ ID NO: 45825 - DNA, 15 bp, Homo sapiens
cccctacagatgttc

SEQ ID NO: 45826 - DNA, 15 bp, Homo sapiens
ccctacagatgttca

SEQ ID NO: 45827 - DNA, 15 bp, Homo sapiens
cctacagatgttcat

SEQ ID NO: 45828 - DNA, 15 bp, Homo sapiens
ctacagatgttcatt

SEQ ID NO: 45829 - DNA, 15 bp, Homo sapiens
tacagatgttcattc

SEQ ID NO: 45830 - DNA, 15 bp, Homo sapiens
acagatgttcattct

SEQ ID NO: 45831 - DNA, 15 bp, Homo sapiens
cagatgttcattctg

SEQ ID NO: 45832 - DNA, 15 bp, Homo sapiens
agatgttcattctgg

SEQ ID NO: 45833 - DNA, 15 bp, Homo sapiens
gatgttcattctgga

SEQ ID NO: 45834 - DNA, 15 bp, Homo sapiens
atgttcattctggac

SEQ ID NO: 45835 - DNA, 15 bp, Homo sapiens
tgttcattctggaca

SEQ ID NO: 45836 - DNA, 15 bp, Homo sapiens
gttcattctggacag

SEQ ID NO: 45837 - DNA, 15 bp, Homo sapiens
ttcattctggacaga

SEQ ID NO: 45838 - DNA, 15 bp, Homo sapiens
tcattctggacagag

SEQ ID NO: 45839 - DNA, 15 bp, Homo sapiens
cattctggacagagt

SEQ ID NO: 45840 - DNA, 15 bp, Homo sapiens
attctggacagagtg

SEQ ID NO: 45841 - DNA, 15 bp, Homo sapiens
ttctggacagagtgg

SEQ ID NO: 45842 - DNA, 15 bp, Homo sapiens
tctggacagagtgga

SEQ ID NO: 45843 - DNA, 15 bp, Homo sapiens
ctggacagagtggaa

SEQ ID NO: 45844 - DNA, 15 bp, Homo sapiens
tggacagagtggaag

SEQ ID NO: 45845 - DNA, 15 bp, Homo sapiens
ggacagagtggaagg

SEQ ID NO: 45846 - DNA, 15 bp, Homo sapiens
gacagagtggaaggt

SEQ ID NO: 45847 - DNA, 15 bp, Homo sapiens
acagagtggaaggtg

SEQ ID NO: 45848 - DNA, 15 bp, Homo sapiens
cagagtggaaggtga

SEQ ID NO: 45849 - DNA, 15 bp, Homo sapiens
agagtggaaggtgat

SEQ ID NO: 45850 - DNA, 15 bp, Homo sapiens
gagtggaaggtgata

SEQ ID NO: 45851 - DNA, 15 bp, Homo sapiens
agtggaaggtgatac

SEQ ID NO: 45852 - DNA, 15 bp, Homo sapiens
gtggaaggtgatact

SEQ ID NO: 45853 - DNA, 15 bp, Homo sapiens
tggaaggtgatactt

SEQ ID NO: 45854 - DNA, 15 bp, Homo sapiens
ggaaggtgatacttg

SEQ ID NO: 45855 - DNA, 15 bp, Homo sapiens
gaaggtgatacttgt

SEQ ID NO: 45856 - DNA, 15 bp, Homo sapiens
aaggtgatacttgtt

SEQ ID NO: 45857 - DNA, 15 bp, Homo sapiens
aggtgatacttgttc

SEQ ID NO: 45858 - DNA, 15 bp, Homo sapiens
ggtgatacttgttcc

SEQ ID NO: 45859 - DNA, 15 bp, Homo sapiens
gtgatacttgttccc

SEQ ID NO: 45860 - DNA, 15 bp, Homo sapiens
tgatacttgttccct

SEQ ID NO: 45861 - DNA, 15 bp, Homo sapiens
gatacttgttccctt

SEQ ID NO: 45862 - DNA, 15 bp, Homo sapiens
atacttgttccctta

SEQ ID NO: 45863 - DNA, 15 bp, Homo sapiens
tacttgttcccttaa

SEQ ID NO: 45864 - DNA, 15 bp, Homo sapiens
acttgttcccttaat

SEQ ID NO: 45865 - DNA, 15 bp, Homo sapiens
cttgttcccttaatg

SEQ ID NO: 45866 - DNA, 15 bp, Homo sapiens
ttgttcccttaatga

SEQ ID NO: 45867 - DNA, 15 bp, Homo sapiens
tgttcccttaatgag

SEQ ID NO: 45868 - DNA, 15 bp, Homo sapiens
gttcccttaatgagt

SEQ ID NO: 45869 - DNA, 15 bp, Homo sapiens
ttcccttaatgagtt

SEQ ID NO: 45870 - DNA, 15 bp, Homo sapiens
tcccttaatgagttt

SEQ ID NO: 45871 - DNA, 15 bp, Homo sapiens
cccttaatgagttta

SEQ ID NO: 45872 - DNA, 15 bp, Homo sapiens
ccttaatgagtttac

SEQ ID NO: 45873 - DNA, 15 bp, Homo sapiens
cttaatgagtttacc

SEQ ID NO: 45874 - DNA, 15 bp, Homo sapiens
ttaatgagtttacca

SEQ ID NO: 45875 - DNA, 15 bp, Homo sapiens
taatgagtttaccat

SEQ ID NO: 45876 - DNA, 15 bp, Homo sapiens
aatgagtttaccata

SEQ ID NO: 45877 - DNA, 15 bp, Homo sapiens
atgagtttaccataa

SEQ ID NO: 45878 - DNA, 15 bp, Homo sapiens
tgagtttaccataac

SEQ ID NO: 45879 - DNA, 15 bp, Homo sapiens
gagtttaccataact

SEQ ID NO: 45880 - DNA, 15 bp, Homo sapiens
agtttaccataactg

SEQ ID NO: 45881 - DNA, 15 bp, Homo sapiens
gtttaccataactgg

SEQ ID NO: 45882 - DNA, 15 bp, Homo sapiens
tttaccataactgga

SEQ ID NO: 45883 - DNA, 15 bp, Homo sapiens
ttaccataactggat

SEQ ID NO: 45884 - DNA, 15 bp, Homo sapiens
taccataactggatc

SEQ ID NO: 45885 - DNA, 15 bp, Homo sapiens
accataactggatca

SEQ ID NO: 45886 - DNA, 15 bp, Homo sapiens
ccataactggatcaa

SEQ ID NO: 45887 - DNA, 15 bp, Homo sapiens
cataactggatcaac

SEQ ID NO: 45888 - DNA, 15 bp, Homo sapiens
ataactggatcaact

SEQ ID NO: 45889 - DNA, 15 bp, Homo sapiens
taactggatcaactt

SEQ ID NO: 45890 - DNA, 15 bp, Homo sapiens
aactggatcaactta

SEQ ID NO: 45891 - DNA, 15 bp, Homo sapiens
actggatcaacttat

SEQ ID NO: 45892 - DNA, 15 bp, Homo sapiens
ctggatcaacttatg

SEQ ID NO: 45893 - DNA, 15 bp, Homo sapiens
tggatcaacttatgc

SEQ ID NO: 45894 - DNA, 15 bp, Homo sapiens
ggatcaacttatgca

SEQ ID NO: 45895 - DNA, 15 bp, Homo sapiens
gatcaacttatgcac

SEQ ID NO: 45896 - DNA, 15 bp, Homo sapiens
atcaacttatgcacc

SEQ ID NO: 45897 - DNA, 15 bp, Homo sapiens
tcaacttatgcacct

SEQ ID NO: 45898 - DNA, 15 bp, Homo sapiens
caacttatgcaccta

SEQ ID NO: 45899 - DNA, 15 bp, Homo sapiens
aacttatgcacctat

SEQ ID NO: 45900 - DNA, 15 bp, Homo sapiens
acttatgcacctatt

SEQ ID NO: 45901 - DNA, 15 bp, Homo sapiens
cttatgcacctattg

SEQ ID NO: 45902 - DNA, 15 bp, Homo sapiens
ttatgcacctattgg

SEQ ID NO: 45903 - DNA, 15 bp, Homo sapiens
tatgcacctattgga

SEQ ID NO: 45904 - DNA, 15 bp, Homo sapiens
atgcacctattggag

SEQ ID NO: 45905 - DNA, 15 bp, Homo sapiens
tgcacctattggaga

SEQ ID NO: 45906 - DNA, 15 bp, Homo sapiens
gcacctattggagaa

SEQ ID NO: 45907 - DNA, 15 bp, Homo sapiens
cacctattggagaag

SEQ ID NO: 45908 - DNA, 15 bp, Homo sapiens
acctattggagaagt

SEQ ID NO: 45909 - DNA, 15 bp, Homo sapiens
cctattggagaagtg

SEQ ID NO: 45910 - DNA, 15 bp, Homo sapiens
ctattggagaagtgt

SEQ ID NO: 45911 - DNA, 15 bp, Homo sapiens
tattggagaagtgtg

SEQ ID NO: 45912 - DNA, 15 bp, Homo sapiens
attggagaagtgtga

SEQ ID NO: 45913 - DNA, 15 bp, Homo sapiens
ttggagaagtgtgag

SEQ ID NO: 45914 - DNA, 15 bp, Homo sapiens
tggagaagtgtgagt

SEQ ID NO: 45915 - DNA, 15 bp, Homo sapiens
ggagaagtgtgagta

SEQ ID NO: 45916 - DNA, 15 bp, Homo sapiens
gagaagtgtgagtaa

SEQ ID NO: 45917 - DNA, 15 bp, Homo sapiens
agaagtgtgagtaac

SEQ ID NO: 45918 - DNA, 15 bp, Homo sapiens
gaagtgtgagtaacc

SEQ ID NO: 45919 - DNA, 15 bp, Homo sapiens
aagtgtgagtaaccc

SEQ ID NO: 45920 - DNA, 15 bp, Homo sapiens
agtgtgagtaaccct

SEQ ID NO: 45921 - DNA, 15 bp, Homo sapiens
gtgtgagtaaccctc

SEQ ID NO: 45922 - DNA, 15 bp, Homo sapiens
tgtgagtaaccctcc

SEQ ID NO: 45923 - DNA, 15 bp, Homo sapiens
gtgagtaaccctcct

SEQ ID NO: 45924 - DNA, 15 bp, Homo sapiens
tgagtaaccctcctc

SEQ ID NO: 45925 - DNA, 15 bp, Homo sapiens
gagtaaccctcctcc

SEQ ID NO: 45926 - DNA, 15 bp, Homo sapiens
agtaaccctcctcct

SEQ ID NO: 45927 - DNA, 15 bp, Homo sapiens
gtaaccctcctcctc

SEQ ID NO: 45928 - DNA, 15 bp, Homo sapiens
taaccctcctcctca

SEQ ID NO: 45929 - DNA, 15 bp, Homo sapiens
aaccctcctcctcat

SEQ ID NO: 45930 - DNA, 15 bp, Homo sapiens
accctcctcctcatt

SEQ ID NO: 45931 - DNA, 15 bp, Homo sapiens
ccctcctcctcattt

SEQ ID NO: 45932 - DNA, 15 bp, Homo sapiens
cctcctcctcattta

SEQ ID NO: 45933 - DNA, 15 bp, Homo sapiens
ctcctcctcatttaa

SEQ ID NO: 45934 - DNA, 15 bp, Homo sapiens
tcctcctcatttaaa

SEQ ID NO: 45935 - DNA, 15 bp, Homo sapiens
cctcctcatttaaag

SEQ ID NO: 45936 - DNA, 15 bp, Homo sapiens
ctcctcatttaaagg

SEQ ID NO: 45937 - DNA, 15 bp, Homo sapiens
tcctcatttaaagga

SEQ ID NO: 45938 - DNA, 15 bp, Homo sapiens
cctcatttaaaggat

SEQ ID NO: 45939 - DNA, 15 bp, Homo sapiens
ctcatttaaaggatc

SEQ ID NO: 45940 - DNA, 15 bp, Homo sapiens
tcatttaaaggatct

SEQ ID NO: 45941 - DNA, 15 bp, Homo sapiens
catttaaaggatctg

SEQ ID NO: 45942 - DNA, 15 bp, Homo sapiens
atttaaaggatctgg

SEQ ID NO: 45943 - DNA, 15 bp, Homo sapiens
tttaaaggatctggt

SEQ ID NO: 45944 - DNA, 15 bp, Homo sapiens
ttaaaggatctggtg

SEQ ID NO: 45945 - DNA, 15 bp, Homo sapiens
taaaggatctggtgt

SEQ ID NO: 45946 - DNA, 15 bp, Homo sapiens
aaaggatctggtgtg

SEQ ID NO: 45947 - DNA, 15 bp, Homo sapiens
aaggatctggtgtgg

SEQ ID NO: 45948 - DNA, 15 bp, Homo sapiens
aggatctggtgtggc

SEQ ID NO: 45949 - DNA, 15 bp, Homo sapiens
ggatctggtgtggca

SEQ ID NO: 45950 - DNA, 15 bp, Homo sapiens
gatctggtgtggcag

SEQ ID NO: 45951 - DNA, 15 bp, Homo sapiens
atctggtgtggcagt

SEQ ID NO: 45952 - DNA, 15 bp, Homo sapiens
tctggtgtggcagtt

SEQ ID NO: 45953 - DNA, 15 bp, Homo sapiens
ctggtgtggcagttt

SEQ ID NO: 45954 - DNA, 15 bp, Homo sapiens
tggtgtggcagttta

SEQ ID NO: 45955 - DNA, 15 bp, Homo sapiens
ggtgtggcagtttag

SEQ ID NO: 45956 - DNA, 15 bp, Homo sapiens
gtgtggcagtttagt

SEQ ID NO: 45957 - DNA, 15 bp, Homo sapiens
tgtggcagtttagta

SEQ ID NO: 45958 - DNA, 15 bp, Homo sapiens
gtggcagtttagtat

SEQ ID NO: 45959 - DNA, 15 bp, Homo sapiens
tggcagtttagtatt

SEQ ID NO: 45960 - DNA, 15 bp, Homo sapiens
ggcagtttagtattt

SEQ ID NO: 45961 - DNA, 15 bp, Homo sapiens
gcagtttagtatttg

SEQ ID NO: 45962 - DNA, 15 bp, Homo sapiens
cagtttagtatttgt

SEQ ID NO: 45963 - DNA, 15 bp, Homo sapiens
agtttagtatttgta

SEQ ID NO: 45964 - DNA, 15 bp, Homo sapiens
gtttagtatttgtat

SEQ ID NO: 45965 - DNA, 15 bp, Homo sapiens
tttagtatttgtatt

SEQ ID NO: 45966 - DNA, 15 bp, Homo sapiens
ttagtatttgtattg

SEQ ID NO: 45967 - DNA, 15 bp, Homo sapiens
tagtatttgtattga

SEQ ID NO: 45968 - DNA, 15 bp, Homo sapiens
agtatttgtattgat

SEQ ID NO: 45969 - DNA, 15 bp, Homo sapiens
gtatttgtattgatt

SEQ ID NO: 45970 - DNA, 15 bp, Homo sapiens
tatttgtattgattt

SEQ ID NO: 45971 - DNA, 15 bp, Homo sapiens
atttgtattgatttg

SEQ ID NO: 45972 - DNA, 15 bp, Homo sapiens
tttgtattgatttgc

SEQ ID NO: 45973 - DNA, 15 bp, Homo sapiens
ttgtattgatttgca

SEQ ID NO: 45974 - DNA, 15 bp, Homo sapiens
tgtattgatttgcag

SEQ ID NO: 45975 - DNA, 15 bp, Homo sapiens
gtattgatttgcagc

SEQ ID NO: 45976 - DNA, 15 bp, Homo sapiens
tattgatttgcagca

SEQ ID NO: 45977 - DNA, 15 bp, Homo sapiens
attgatttgcagcat

SEQ ID NO: 45978 - DNA, 15 bp, Homo sapiens
ttgatttgcagcatg

SEQ ID NO: 45979 - DNA, 15 bp, Homo sapiens
tgatttgcagcatgt

SEQ ID NO: 45980 - DNA, 15 bp, Homo sapiens
gatttgcagcatgtc

SEQ ID NO: 45981 - DNA, 15 bp, Homo sapiens
atttgcagcatgtct

SEQ ID NO: 45982 - DNA, 15 bp, Homo sapiens
tttgcagcatgtcta

SEQ ID NO: 45983 - DNA, 15 bp, Homo sapiens
ttgcagcatgtctac

SEQ ID NO: 45984 - DNA, 15 bp, Homo sapiens
tgcagcatgtctaca

SEQ ID NO: 45985 - DNA, 15 bp, Homo sapiens
gcagcatgtctacaa

SEQ ID NO: 45986 - DNA, 15 bp, Homo sapiens
cagcatgtctacaaa

SEQ ID NO: 45987 - DNA, 15 bp, Homo sapiens
agcatgtctacaaag

SEQ ID NO: 45988 - DNA, 15 bp, Homo sapiens
gcatgtctacaaagt

SEQ ID NO: 45989 - DNA, 15 bp, Homo sapiens
catgtctacaaagtt

SEQ ID NO: 45990 - DNA, 15 bp, Homo sapiens
atgtctacaaagtta

SEQ ID NO: 45991 - DNA, 15 bp, Homo sapiens
tgtctacaaagttaa

SEQ ID NO: 45992 - DNA, 15 bp, Homo sapiens
gtctacaaagttaag

SEQ ID NO: 45993 - DNA, 15 bp, Homo sapiens
tctacaaagttaaga

SEQ ID NO: 45994 - DNA, 15 bp, Homo sapiens
ctacaaagttaagac

SEQ ID NO: 45995 - DNA, 15 bp, Homo sapiens
tacaaagttaagaca

SEQ ID NO: 45996 - DNA, 15 bp, Homo sapiens
acaaagttaagacag

SEQ ID NO: 45997 - DNA, 15 bp, Homo sapiens
caaagttaagacagc

SEQ ID NO: 45998 - DNA, 15 bp, Homo sapiens
aaagttaagacagct

SEQ ID NO: 45999 - DNA, 15 bp, Homo sapiens
aagttaagacagctt

SEQ ID NO: 46000 - DNA, 15 bp, Homo sapiens
agttaagacagcttt

SEQ ID NO: 46001 - DNA, 15 bp, Homo sapiens
gttaagacagctttc

SEQ ID NO: 46002 - DNA, 15 bp, Homo sapiens
ttaagacagctttct

SEQ ID NO: 46003 - DNA, 15 bp, Homo sapiens
taagacagctttctg

SEQ ID NO: 46004 - DNA, 15 bp, Homo sapiens
aagacagctttctga

SEQ ID NO: 46005 - DNA, 15 bp, Homo sapiens
agacagctttctgaa

SEQ ID NO: 46006 - DNA, 15 bp, Homo sapiens
gacagctttctgaat

SEQ ID NO: 46007 - DNA, 15 bp, Homo sapiens
acagctttctgaatg

SEQ ID NO: 46008 - DNA, 15 bp, Homo sapiens
cagctttctgaatgt

SEQ ID NO: 46009 - DNA, 15 bp, Homo sapiens
agctttctgaatgtg

SEQ ID NO: 46010 - DNA, 15 bp, Homo sapiens
gctttctgaatgtgg

SEQ ID NO: 46011 - DNA, 15 bp, Homo sapiens
ctttctgaatgtggc

SEQ ID NO: 46012 - DNA, 15 bp, Homo sapiens
tttctgaatgtggct

SEQ ID NO: 46013 - DNA, 15 bp, Homo sapiens
ttctgaatgtggctc

SEQ ID NO: 46014 - DNA, 15 bp, Homo sapiens
tctgaatgtggctca

SEQ ID NO: 46015 - DNA, 15 bp, Homo sapiens
ctgaatgtggctcaa

SEQ ID NO: 46016 - DNA, 15 bp, Homo sapiens
tgaatgtggctcaag

SEQ ID NO: 46017 - DNA, 15 bp, Homo sapiens
gaatgtggctcaagt

SEQ ID NO: 46018 - DNA, 15 bp, Homo sapiens
aatgtggctcaagtc

SEQ ID NO: 46019 - DNA, 15 bp, Homo sapiens
atgtggctcaagtca

SEQ ID NO: 46020 - DNA, 15 bp, Homo sapiens
tgtggctcaagtcaa

SEQ ID NO: 46021 - DNA, 15 bp, Homo sapiens
gtggctcaagtcaac

SEQ ID NO: 46022 - DNA, 15 bp, Homo sapiens
tggctcaagtcaaca

SEQ ID NO: 46023 - DNA, 15 bp, Homo sapiens
ggctcaagtcaacac

SEQ ID NO: 46024 - DNA, 15 bp, Homo sapiens
gctcaagtcaacact

SEQ ID NO: 46025 - DNA, 15 bp, Homo sapiens
ctcaagtcaacactt

SEQ ID NO: 46026 - DNA, 15 bp, Homo sapiens
tcaagtcaacactta

SEQ ID NO: 46027 - DNA, 15 bp, Homo sapiens
caagtcaacacttat

SEQ ID NO: 46028 - DNA, 15 bp, Homo sapiens
aagtcaacacttatt

SEQ ID NO: 46029 - DNA, 15 bp, Homo sapiens
agtcaacacttatta

SEQ ID NO: 46030 - DNA, 15 bp, Homo sapiens
gtcaacacttattac

SEQ ID NO: 46031 - DNA, 15 bp, Homo sapiens
tcaacacttattact

SEQ ID NO: 46032 - DNA, 15 bp, Homo sapiens
caacacttattacta

SEQ ID NO: 46033 - DNA, 15 bp, Homo sapiens
aacacttattactaa

SEQ ID NO: 46034 - DNA, 15 bp, Homo sapiens
acacttattactaaa

SEQ ID NO: 46035 - DNA, 15 bp, Homo sapiens
cacttattactaaag

SEQ ID NO: 46036 - DNA, 15 bp, Homo sapiens
acttattactaaagt

SEQ ID NO: 46037 - DNA, 15 bp, Homo sapiens
cttattactaaagta

SEQ ID NO: 46038 - DNA, 15 bp, Homo sapiens
ttattactaaagtag

SEQ ID NO: 46039 - DNA, 15 bp, Homo sapiens
tattactaaagtagt

SEQ ID NO: 46040 - DNA, 15 bp, Homo sapiens
attactaaagtagta

SEQ ID NO: 46041 - DNA, 15 bp, Homo sapiens
ttactaaagtagtaa

SEQ ID NO: 46042 - DNA, 15 bp, Homo sapiens
tactaaagtagtaaa

SEQ ID NO: 46043 - DNA, 15 bp, Homo sapiens
actaaagtagtaaat

SEQ ID NO: 46044 - DNA, 15 bp, Homo sapiens
ctaaagtagtaaatg

SEQ ID NO: 46045 - DNA, 15 bp, Homo sapiens
taaagtagtaaatgt

SEQ ID NO: 46046 - DNA, 15 bp, Homo sapiens
aaagtagtaaatgtt

SEQ ID NO: 46047 - DNA, 15 bp, Homo sapiens
aagtagtaaatgttt

SEQ ID NO: 46048 - DNA, 15 bp, Homo sapiens
agtagtaaatgtttt

SEQ ID NO: 46049 - DNA, 15 bp, Homo sapiens
gtagtaaatgttttt

SEQ ID NO: 46050 - DNA, 15 bp, Homo sapiens
tagtaaatgttttta

SEQ ID NO: 46051 - DNA, 15 bp, Homo sapiens
agtaaatgtttttaa

SEQ ID NO: 46052 - DNA, 15 bp, Homo sapiens
gtaaatgtttttaaa

SEQ ID NO: 46053 - DNA, 15 bp, Homo sapiens
taaatgtttttaaaa

SEQ ID NO: 46054 - DNA, 15 bp, Homo sapiens
aaatgtttttaaaac

SEQ ID NO: 46055 - DNA, 15 bp, Homo sapiens
aatgtttttaaaaca

SEQ ID NO: 46056 - DNA, 15 bp, Homo sapiens
atgtttttaaaacaa

SEQ ID NO: 46057 - DNA, 15 bp, Homo sapiens
tgtttttaaaacaaa

SEQ ID NO: 46058 - DNA, 15 bp, Homo sapiens
gtttttaaaacaaaa

SEQ ID NO: 46059 - DNA, 15 bp, Homo sapiens
tttttaaaacaaaaa

SEQ ID NO: 46060 - DNA, 15 bp, Homo sapiens
ttttaaaacaaaaac

SEQ ID NO: 46061 - DNA, 15 bp, Homo sapiens
tttaaaacaaaaact

SEQ ID NO: 46062 - DNA, 15 bp, Homo sapiens
ttaaaacaaaaactt

SEQ ID NO: 46063 - DNA, 15 bp, Homo sapiens
taaaacaaaaacttt

SEQ ID NO: 46064 - DNA, 15 bp, Homo sapiens
aaaacaaaaactttg

SEQ ID NO: 46065 - DNA, 15 bp, Homo sapiens
aaacaaaaactttga

SEQ ID NO: 46066 - DNA, 15 bp, Homo sapiens
aacaaaaactttgaa

SEQ ID NO: 46067 - DNA, 15 bp, Homo sapiens
acaaaaactttgaaa

SEQ ID NO: 46068 - DNA, 15 bp, Homo sapiens
caaaaactttgaaag

SEQ ID NO: 46069 - DNA, 15 bp, Homo sapiens
aaaaactttgaaaga

SEQ ID NO: 46070 - DNA, 15 bp, Homo sapiens
aaaactttgaaagat

SEQ ID NO: 46071 - DNA, 15 bp, Homo sapiens
aaactttgaaagatg

SEQ ID NO: 46072 - DNA, 15 bp, Homo sapiens
aactttgaaagatga

SEQ ID NO: 46073 - DNA, 15 bp, Homo sapiens
actttgaaagatgaa

SEQ ID NO: 46074 - DNA, 15 bp, Homo sapiens
ctttgaaagatgaac

SEQ ID NO: 46075 - DNA, 15 bp, Homo sapiens
tttgaaagatgaacc

SEQ ID NO: 46076 - DNA, 15 bp, Homo sapiens
ttgaaagatgaacca

SEQ ID NO: 46077 - DNA, 15 bp, Homo sapiens
tgaaagatgaaccaa

SEQ ID NO: 46078 - DNA, 15 bp, Homo sapiens
gaaagatgaaccaaa

SEQ ID NO: 46079 - DNA, 15 bp, Homo sapiens
aaagatgaaccaaag

SEQ ID NO: 46080 - DNA, 15 bp, Homo sapiens
aagatgaaccaaagg

SEQ ID NO: 46081 - DNA, 15 bp, Homo sapiens
agatgaaccaaaggt

SEQ ID NO: 46082 - DNA, 15 bp, Homo sapiens
gatgaaccaaaggtt

SEQ ID NO: 46083 - DNA, 15 bp, Homo sapiens
atgaaccaaaggtta

SEQ ID NO: 46084 - DNA, 15 bp, Homo sapiens
tgaaccaaaggttat

SEQ ID NO: 46085 - DNA, 15 bp, Homo sapiens
gaaccaaaggttata

SEQ ID NO: 46086 - DNA, 15 bp, Homo sapiens
aaccaaaggttataa

SEQ ID NO: 46087 - DNA, 15 bp, Homo sapiens
accaaaggttataat

SEQ ID NO: 46088 - DNA, 15 bp, Homo sapiens
ccaaaggttataatc

SEQ ID NO: 46089 - DNA, 15 bp, Homo sapiens
caaaggttataatcc

SEQ ID NO: 46090 - DNA, 15 bp, Homo sapiens
aaaggttataatcca

SEQ ID NO: 46091 - DNA, 15 bp, Homo sapiens
aaggttataatccag

SEQ ID NO: 46092 - DNA, 15 bp, Homo sapiens
aggttataatccagt

SEQ ID NO: 46093 - DNA, 15 bp, Homo sapiens
ggttataatccagtc

SEQ ID NO: 46094 - DNA, 15 bp, Homo sapiens
gttataatccagtca

SEQ ID NO: 46095 - DNA, 15 bp, Homo sapiens
ttataatccagtcat

SEQ ID NO: 46096 - DNA, 15 bp, Homo sapiens
tataatccagtcatc

SEQ ID NO: 46097 - DNA, 15 bp, Homo sapiens
ataatccagtcatct

SEQ ID NO: 46098 - DNA, 15 bp, Homo sapiens
taatccagtcatctt

SEQ ID NO: 46099 - DNA, 15 bp, Homo sapiens
aatccagtcatcttt

SEQ ID NO: 46100 - DNA, 15 bp, Homo sapiens
atccagtcatctttt

SEQ ID NO: 46101 - DNA, 15 bp, Homo sapiens
tccagtcatcttttt

SEQ ID NO: 46102 - DNA, 15 bp, Homo sapiens
ccagtcatctttttg

SEQ ID NO: 46103 - DNA, 15 bp, Homo sapiens
cagtcatctttttgc

SEQ ID NO: 46104 - DNA, 15 bp, Homo sapiens
agtcatctttttgca

SEQ ID NO: 46105 - DNA, 15 bp, Homo sapiens
gtcatctttttgcat

SEQ ID NO: 46106 - DNA, 15 bp, Homo sapiens
tcatctttttgcatc

SEQ ID NO: 46107 - DNA, 15 bp, Homo sapiens
catctttttgcatct

SEQ ID NO: 46108 - DNA, 15 bp, Homo sapiens
atctttttgcatctt

SEQ ID NO: 46109 - DNA, 15 bp, Homo sapiens
tctttttgcatcttc

SEQ ID NO: 46110 - DNA, 15 bp, Homo sapiens
ctttttgcatcttct

SEQ ID NO: 46111 - DNA, 15 bp, Homo sapiens
tttttgcatcttctg

SEQ ID NO: 46112 - DNA, 15 bp, Homo sapiens
ttttgcatcttctgg

SEQ ID NO: 46113 - DNA, 15 bp, Homo sapiens
tttgcatcttctggg

SEQ ID NO: 46114 - DNA, 15 bp, Homo sapiens
ttgcatcttctgggc

SEQ ID NO: 46115 - DNA, 15 bp, Homo sapiens
tgcatcttctgggct

SEQ ID NO: 46116 - DNA, 15 bp, Homo sapiens
gcatcttctgggctc

SEQ ID NO: 46117 - DNA, 15 bp, Homo sapiens
catcttctgggctcc

SEQ ID NO: 46118 - DNA, 15 bp, Homo sapiens
atcttctgggctcca

SEQ ID NO: 46119 - DNA, 15 bp, Homo sapiens
tcttctgggctccaa

SEQ ID NO: 46120 - DNA, 15 bp, Homo sapiens
cttctgggctccaaa

SEQ ID NO: 46121 - DNA, 15 bp, Homo sapiens
ttctgggctccaaac

SEQ ID NO: 46122 - DNA, 15 bp, Homo sapiens
tctgggctccaaact

SEQ ID NO: 46123 - DNA, 15 bp, Homo sapiens
ctgggctccaaactt

SEQ ID NO: 46124 - DNA, 15 bp, Homo sapiens
tgggctccaaacttt

SEQ ID NO: 46125 - DNA, 15 bp, Homo sapiens
gggctccaaactttc

SEQ ID NO: 46126 - DNA, 15 bp, Homo sapiens
ggctccaaactttca

SEQ ID NO: 46127 - DNA, 15 bp, Homo sapiens
gctccaaactttcaa

SEQ ID NO: 46128 - DNA, 15 bp, Homo sapiens
ctccaaactttcaag

SEQ ID NO: 46129 - DNA, 15 bp, Homo sapiens
tccaaactttcaaga

SEQ ID NO: 46130 - DNA, 15 bp, Homo sapiens
ccaaactttcaagag

SEQ ID NO: 46131 - DNA, 15 bp, Homo sapiens
caaactttcaagagg

SEQ ID NO: 46132 - DNA, 15 bp, Homo sapiens
aaactttcaagaggg

SEQ ID NO: 46133 - DNA, 15 bp, Homo sapiens
aactttcaagaggga

SEQ ID NO: 46134 - DNA, 15 bp, Homo sapiens
actttcaagagggat

SEQ ID NO: 46135 - DNA, 15 bp, Homo sapiens
ctttcaagagggatt

SEQ ID NO: 46136 - DNA, 15 bp, Homo sapiens
tttcaagagggattt

SEQ ID NO: 46137 - DNA, 15 bp, Homo sapiens
ttcaagagggatttg

SEQ ID NO: 46138 - DNA, 15 bp, Homo sapiens
tcaagagggatttgt

SEQ ID NO: 46139 - DNA, 15 bp, Homo sapiens
caagagggatttgtg

SEQ ID NO: 46140 - DNA, 15 bp, Homo sapiens
aagagggatttgtgt

SEQ ID NO: 46141 - DNA, 15 bp, Homo sapiens
agagggatttgtgtt

SEQ ID NO: 46142 - DNA, 15 bp, Homo sapiens
gagggatttgtgttt

SEQ ID NO: 46143 - DNA, 15 bp, Homo sapiens
agggatttgtgtttg

SEQ ID NO: 46144 - DNA, 15 bp, Homo sapiens
gggatttgtgtttgt

SEQ ID NO: 46145 - DNA, 15 bp, Homo sapiens
ggatttgtgtttgtt

SEQ ID NO: 46146 - DNA, 15 bp, Homo sapiens
gatttgtgtttgtta

SEQ ID NO: 46147 - DNA, 15 bp, Homo sapiens
atttgtgtttgttat

SEQ ID NO: 46148 - DNA, 15 bp, Homo sapiens
tttgtgtttgttatt

SEQ ID NO: 46149 - DNA, 15 bp, Homo sapiens
ttgtgtttgttattc

SEQ ID NO: 46150 - DNA, 15 bp, Homo sapiens
tgtgtttgttattca

SEQ ID NO: 46151 - DNA, 15 bp, Homo sapiens
gtgtttgttattcac

SEQ ID NO: 46152 - DNA, 15 bp, Homo sapiens
tgtttgttattcact

SEQ ID NO: 46153 - DNA, 15 bp, Homo sapiens
gtttgttattcactg

SEQ ID NO: 46154 - DNA, 15 bp, Homo sapiens
tttgttattcactgt

SEQ ID NO: 46155 - DNA, 15 bp, Homo sapiens
ttgttattcactgta

SEQ ID NO: 46156 - DNA, 15 bp, Homo sapiens
tgttattcactgtag

SEQ ID NO: 46157 - DNA, 15 bp, Homo sapiens
gttattcactgtagc

SEQ ID NO: 46158 - DNA, 15 bp, Homo sapiens
ttattcactgtagcc

SEQ ID NO: 46159 - DNA, 15 bp, Homo sapiens
tattcactgtagcca

SEQ ID NO: 46160 - DNA, 15 bp, Homo sapiens
attcactgtagccag

SEQ ID NO: 46161 - DNA, 15 bp, Homo sapiens
ttcactgtagccagt

SEQ ID NO: 46162 - DNA, 15 bp, Homo sapiens
tcactgtagccagtg

SEQ ID NO: 46163 - DNA, 15 bp, Homo sapiens
cactgtagccagtgg

SEQ ID NO: 46164 - DNA, 15 bp, Homo sapiens
actgtagccagtggt

SEQ ID NO: 46165 - DNA, 15 bp, Homo sapiens
ctgtagccagtggtg

SEQ ID NO: 46166 - DNA, 15 bp, Homo sapiens
tgtagccagtggtgg

SEQ ID NO: 46167 - DNA, 15 bp, Homo sapiens
gtagccagtggtgga

SEQ ID NO: 46168 - DNA, 15 bp, Homo sapiens
tagccagtggtggaa

SEQ ID NO: 46169 - DNA, 15 bp, Homo sapiens
agccagtggtggaag

SEQ ID NO: 46170 - DNA, 15 bp, Homo sapiens
gccagtggtggaaga

SEQ ID NO: 46171 - DNA, 15 bp, Homo sapiens
ccagtggtggaagaa

SEQ ID NO: 46172 - DNA, 15 bp, Homo sapiens
cagtggtggaagaat

SEQ ID NO: 46173 - DNA, 15 bp, Homo sapiens
agtggtggaagaatt

SEQ ID NO: 46174 - DNA, 15 bp, Homo sapiens
gtggtggaagaattg

SEQ ID NO: 46175 - DNA, 15 bp, Homo sapiens
tggtggaagaattga

SEQ ID NO: 46176 - DNA, 15 bp, Homo sapiens
ggtggaagaattgaa

SEQ ID NO: 46177 - DNA, 15 bp, Homo sapiens
gtggaagaattgaat

SEQ ID NO: 46178 - DNA, 15 bp, Homo sapiens
tggaagaattgaatt

SEQ ID NO: 46179 - DNA, 15 bp, Homo sapiens
ggaagaattgaatta

SEQ ID NO: 46180 - DNA, 15 bp, Homo sapiens
gaagaattgaattaa

SEQ ID NO: 46181 - DNA, 15 bp, Homo sapiens
aagaattgaattaag

SEQ ID NO: 46182 - DNA, 15 bp, Homo sapiens
agaattgaattaaga

SEQ ID NO: 46183 - DNA, 15 bp, Homo sapiens
gaattgaattaagaa

SEQ ID NO: 46184 - DNA, 15 bp, Homo sapiens
aattgaattaagaat

SEQ ID NO: 46185 - DNA, 15 bp, Homo sapiens
attgaattaagaatt

SEQ ID NO: 46186 - DNA, 15 bp, Homo sapiens
ttgaattaagaattt

SEQ ID NO: 46187 - DNA, 15 bp, Homo sapiens
tgaattaagaatttc

SEQ ID NO: 46188 - DNA, 15 bp, Homo sapiens
gaattaagaatttct

SEQ ID NO: 46189 - DNA, 15 bp, Homo sapiens
aattaagaatttctg

SEQ ID NO: 46190 - DNA, 15 bp, Homo sapiens
attaagaatttctgg

SEQ ID NO: 46191 - DNA, 15 bp, Homo sapiens
ttaagaatttctggt

SEQ ID NO: 46192 - DNA, 15 bp, Homo sapiens
taagaatttctggtc

SEQ ID NO: 46193 - DNA, 15 bp, Homo sapiens
aagaatttctggtct

SEQ ID NO: 46194 - DNA, 15 bp, Homo sapiens
agaatttctggtctt

SEQ ID NO: 46195 - DNA, 15 bp, Homo sapiens
gaatttctggtcttt

SEQ ID NO: 46196 - DNA, 15 bp, Homo sapiens
aatttctggtctttt

SEQ ID NO: 46197 - DNA, 15 bp, Homo sapiens
atttctggtcttttt

SEQ ID NO: 46198 - DNA, 15 bp, Homo sapiens
tttctggtcttttta

SEQ ID NO: 46199 - DNA, 15 bp, Homo sapiens
ttctggtctttttac

SEQ ID NO: 46200 - DNA, 15 bp, Homo sapiens
tctggtctttttact

SEQ ID NO: 46201 - DNA, 15 bp, Homo sapiens
ctggtctttttactg

SEQ ID NO: 46202 - DNA, 15 bp, Homo sapiens
tggtctttttactga

SEQ ID NO: 46203 - DNA, 15 bp, Homo sapiens
ggtctttttactgat

SEQ ID NO: 46204 - DNA, 15 bp, Homo sapiens
gtctttttactgatt

SEQ ID NO: 46205 - DNA, 15 bp, Homo sapiens
tctttttactgattg

SEQ ID NO: 46206 - DNA, 15 bp, Homo sapiens
ctttttactgattga

SEQ ID NO: 46207 - DNA, 15 bp, Homo sapiens
tttttactgattgat

SEQ ID NO: 46208 - DNA, 15 bp, Homo sapiens
ttttactgattgatt

SEQ ID NO: 46209 - DNA, 15 bp, Homo sapiens
tttactgattgattt

SEQ ID NO: 46210 - DNA, 15 bp, Homo sapiens
ttactgattgatttc

SEQ ID NO: 46211 - DNA, 15 bp, Homo sapiens
tactgattgatttct

SEQ ID NO: 46212 - DNA, 15 bp, Homo sapiens
actgattgatttctg

SEQ ID NO: 46213 - DNA, 15 bp, Homo sapiens
ctgattgatttctga

SEQ ID NO: 46214 - DNA, 15 bp, Homo sapiens
tgattgatttctgat

SEQ ID NO: 46215 - DNA, 15 bp, Homo sapiens
gattgatttctgata

SEQ ID NO: 46216 - DNA, 15 bp, Homo sapiens
attgatttctgatac

SEQ ID NO: 46217 - DNA, 15 bp, Homo sapiens
ttgatttctgatacc

SEQ ID NO: 46218 - DNA, 15 bp, Homo sapiens
tgatttctgatacca

SEQ ID NO: 46219 - DNA, 15 bp, Homo sapiens
gatttctgataccag

SEQ ID NO: 46220 - DNA, 15 bp, Homo sapiens
atttctgataccaga

SEQ ID NO: 46221 - DNA, 15 bp, Homo sapiens
tttctgataccagag

SEQ ID NO: 46222 - DNA, 15 bp, Homo sapiens
ttctgataccagaga

SEQ ID NO: 46223 - DNA, 15 bp, Homo sapiens
tctgataccagagat

SEQ ID NO: 46224 - DNA, 15 bp, Homo sapiens
ctgataccagagatg

SEQ ID NO: 46225 - DNA, 15 bp, Homo sapiens
tgataccagagatgc

SEQ ID NO: 46226 - DNA, 15 bp, Homo sapiens
gataccagagatgca

SEQ ID NO: 46227 - DNA, 15 bp, Homo sapiens
ataccagagatgcat

SEQ ID NO: 46228 - DNA, 15 bp, Homo sapiens
taccagagatgcatt

SEQ ID NO: 46229 - DNA, 15 bp, Homo sapiens
accagagatgcattc

SEQ ID NO: 46230 - DNA, 15 bp, Homo sapiens
ccagagatgcattct

SEQ ID NO: 46231 - DNA, 15 bp, Homo sapiens
cagagatgcattctc

SEQ ID NO: 46232 - DNA, 15 bp, Homo sapiens
agagatgcattctct

SEQ ID NO: 46233 - DNA, 15 bp, Homo sapiens
gagatgcattctctc

SEQ ID NO: 46234 - DNA, 15 bp, Homo sapiens
agatgcattctctct

SEQ ID NO: 46235 - DNA, 15 bp, Homo sapiens
gatgcattctctctt

SEQ ID NO: 46236 - DNA, 15 bp, Homo sapiens
atgcattctctcttt

SEQ ID NO: 46237 - DNA, 15 bp, Homo sapiens
tgcattctctctttt

SEQ ID NO: 46238 - DNA, 15 bp, Homo sapiens
gcattctctcttttg

SEQ ID NO: 46239 - DNA, 15 bp, Homo sapiens
cattctctcttttgt

SEQ ID NO: 46240 - DNA, 15 bp, Homo sapiens
attctctcttttgtt

SEQ ID NO: 46241 - DNA, 15 bp, Homo sapiens
ttctctcttttgttt

SEQ ID NO: 46242 - DNA, 15 bp, Homo sapiens
tctctcttttgtttt

SEQ ID NO: 46243 - DNA, 15 bp, Homo sapiens
ctctcttttgttttt

SEQ ID NO: 46244 - DNA, 15 bp, Homo sapiens
tctcttttgtttttg

SEQ ID NO: 46245 - DNA, 15 bp, Homo sapiens
ctcttttgtttttgt

SEQ ID NO: 46246 - DNA, 15 bp, Homo sapiens
tcttttgtttttgtc

SEQ ID NO: 46247 - DNA, 15 bp, Homo sapiens
cttttgtttttgtct

SEQ ID NO: 46248 - DNA, 15 bp, Homo sapiens
ttttgtttttgtcta

SEQ ID NO: 46249 - DNA, 15 bp, Homo sapiens
tttgtttttgtctaa

SEQ ID NO: 46250 - DNA, 15 bp, Homo sapiens
ttgtttttgtctaat

SEQ ID NO: 46251 - DNA, 15 bp, Homo sapiens
tgtttttgtctaata

SEQ ID NO: 46252 - DNA, 15 bp, Homo sapiens
gtttttgtctaatat

SEQ ID NO: 46253 - DNA, 15 bp, Homo sapiens
tttttgtctaatatt

SEQ ID NO: 46254 - DNA, 15 bp, Homo sapiens
ttttgtctaatattg

SEQ ID NO: 46255 - DNA, 15 bp, Homo sapiens
tttgtctaatattgg

SEQ ID NO: 46256 - DNA, 15 bp, Homo sapiens
ttgtctaatattggc

SEQ ID NO: 46257 - DNA, 15 bp, Homo sapiens
tgtctaatattggct

SEQ ID NO: 46258 - DNA, 15 bp, Homo sapiens
gtctaatattggctc

SEQ ID NO: 46259 - DNA, 15 bp, Homo sapiens
tctaatattggctct

SEQ ID NO: 46260 - DNA, 15 bp, Homo sapiens
ctaatattggctctg

SEQ ID NO: 46261 - DNA, 15 bp, Homo sapiens
taatattggctctgg

SEQ ID NO: 46262 - DNA, 15 bp, Homo sapiens
aatattggctctggc

SEQ ID NO: 46263 - DNA, 15 bp, Homo sapiens
atattggctctggca

SEQ ID NO: 46264 - DNA, 15 bp, Homo sapiens
tattggctctggcat

SEQ ID NO: 46265 - DNA, 15 bp, Homo sapiens
attggctctggcatc

SEQ ID NO: 46266 - DNA, 15 bp, Homo sapiens
ttggctctggcatca

SEQ ID NO: 46267 - DNA, 15 bp, Homo sapiens
tggctctggcatcaa

SEQ ID NO: 46268 - DNA, 15 bp, Homo sapiens
ggctctggcatcaaa

SEQ ID NO: 46269 - DNA, 15 bp, Homo sapiens
gctctggcatcaaat

SEQ ID NO: 46270 - DNA, 15 bp, Homo sapiens
ctctggcatcaaatt

SEQ ID NO: 46271 - DNA, 15 bp, Homo sapiens
tctggcatcaaattg

SEQ ID NO: 46272 - DNA, 15 bp, Homo sapiens
ctggcatcaaattgt

SEQ ID NO: 46273 - DNA, 15 bp, Homo sapiens
tggcatcaaattgtt

SEQ ID NO: 46274 - DNA, 15 bp, Homo sapiens
ggcatcaaattgttt

SEQ ID NO: 46275 - DNA, 15 bp, Homo sapiens
gcatcaaattgtttg

SEQ ID NO: 46276 - DNA, 15 bp, Homo sapiens
catcaaattgtttgg

SEQ ID NO: 46277 - DNA, 15 bp, Homo sapiens
atcaaattgtttgga

SEQ ID NO: 46278 - DNA, 15 bp, Homo sapiens
tcaaattgtttggaa

SEQ ID NO: 46279 - DNA, 15 bp, Homo sapiens
caaattgtttggaat

SEQ ID NO: 46280 - DNA, 15 bp, Homo sapiens
aaattgtttggaatt

SEQ ID NO: 46281 - DNA, 15 bp, Homo sapiens
aattgtttggaattt

SEQ ID NO: 46282 - DNA, 15 bp, Homo sapiens
attgtttggaatttt

SEQ ID NO: 46283 - DNA, 15 bp, Homo sapiens
ttgtttggaattttt

SEQ ID NO: 46284 - DNA, 15 bp, Homo sapiens
tgtttggaatttttt

SEQ ID NO: 46285 - DNA, 15 bp, Homo sapiens
gtttggaattttttc

SEQ ID NO: 46286 - DNA, 15 bp, Homo sapiens
tttggaattttttcc

SEQ ID NO: 46287 - DNA, 15 bp, Homo sapiens
ttggaattttttcca

SEQ ID NO: 46288 - DNA, 15 bp, Homo sapiens
tggaattttttccag

SEQ ID NO: 46289 - DNA, 15 bp, Homo sapiens
ggaattttttccagt

SEQ ID NO: 46290 - DNA, 15 bp, Homo sapiens
gaattttttccagta

SEQ ID NO: 46291 - DNA, 15 bp, Homo sapiens
aattttttccagtat

SEQ ID NO: 46292 - DNA, 15 bp, Homo sapiens
attttttccagtatg

SEQ ID NO: 46293 - DNA, 15 bp, Homo sapiens
ttttttccagtatgt

SEQ ID NO: 46294 - DNA, 15 bp, Homo sapiens
tttttccagtatgtt

SEQ ID NO: 46295 - DNA, 15 bp, Homo sapiens
ttttccagtatgttg

SEQ ID NO: 46296 - DNA, 15 bp, Homo sapiens
tttccagtatgttgt

SEQ ID NO: 46297 - DNA, 15 bp, Homo sapiens
ttccagtatgttgtc

SEQ ID NO: 46298 - DNA, 15 bp, Homo sapiens
tccagtatgttgtcc

SEQ ID NO: 46299 - DNA, 15 bp, Homo sapiens
ccagtatgttgtccc

SEQ ID NO: 46300 - DNA, 15 bp, Homo sapiens
cagtatgttgtccca

SEQ ID NO: 46301 - DNA, 15 bp, Homo sapiens
agtatgttgtcccag

SEQ ID NO: 46302 - DNA, 15 bp, Homo sapiens
gtatgttgtcccaga

SEQ ID NO: 46303 - DNA, 15 bp, Homo sapiens
tatgttgtcccagaa

SEQ ID NO: 46304 - DNA, 15 bp, Homo sapiens
atgttgtcccagaaa

SEQ ID NO: 46305 - DNA, 15 bp, Homo sapiens
tgttgtcccagaaat

SEQ ID NO: 46306 - DNA, 15 bp, Homo sapiens
gttgtcccagaaatt

SEQ ID NO: 46307 - DNA, 15 bp, Homo sapiens
ttgtcccagaaattc

SEQ ID NO: 46308 - DNA, 15 bp, Homo sapiens
tgtcccagaaattct

SEQ ID NO: 46309 - DNA, 15 bp, Homo sapiens
gtcccagaaattctg

SEQ ID NO: 46310 - DNA, 15 bp, Homo sapiens
tcccagaaattctgt

SEQ ID NO: 46311 - DNA, 15 bp, Homo sapiens
cccagaaattctgtt

SEQ ID NO: 46312 - DNA, 15 bp, Homo sapiens
ccagaaattctgttt

SEQ ID NO: 46313 - DNA, 15 bp, Homo sapiens
cagaaattctgtttt

SEQ ID NO: 46314 - DNA, 15 bp, Homo sapiens
agaaattctgttttc

SEQ ID NO: 46315 - DNA, 15 bp, Homo sapiens
gaaattctgttttca

SEQ ID NO: 46316 - DNA, 15 bp, Homo sapiens
aaattctgttttcat

SEQ ID NO: 46317 - DNA, 15 bp, Homo sapiens
aattctgttttcatt

SEQ ID NO: 46318 - DNA, 15 bp, Homo sapiens
attctgttttcatta

SEQ ID NO: 46319 - DNA, 15 bp, Homo sapiens
ttctgttttcattat

SEQ ID NO: 46320 - DNA, 15 bp, Homo sapiens
tctgttttcattatt

SEQ ID NO: 46321 - DNA, 15 bp, Homo sapiens
ctgttttcattatta

SEQ ID NO: 46322 - DNA, 15 bp, Homo sapiens
tgttttcattattaa

SEQ ID NO: 46323 - DNA, 15 bp, Homo sapiens
gttttcattattaaa

SEQ ID NO: 46324 - DNA, 15 bp, Homo sapiens
ttttcattattaaac

SEQ ID NO: 46325 - DNA, 15 bp, Homo sapiens
tttcattattaaaca

SEQ ID NO: 46326 - DNA, 15 bp, Homo sapiens
ttcattattaaacaa

SEQ ID NO: 46327 - DNA, 15 bp, Homo sapiens
tcattattaaacaat

SEQ ID NO: 46328 - DNA, 15 bp, Homo sapiens
cattattaaacaatt

SEQ ID NO: 46329 - DNA, 15 bp, Homo sapiens
attattaaacaattg

SEQ ID NO: 46330 - DNA, 15 bp, Homo sapiens
ttattaaacaattgc

SEQ ID NO: 46331 - DNA, 15 bp, Homo sapiens
tattaaacaattgcg

SEQ ID NO: 46332 - DNA, 15 bp, Homo sapiens
attaaacaattgcgg

SEQ ID NO: 46333 - DNA, 15 bp, Homo sapiens
ttaaacaattgcggg

SEQ ID NO: 46334 - DNA, 15 bp, Homo sapiens
taaacaattgcgggg

SEQ ID NO: 46335 - DNA, 15 bp, Homo sapiens
aaacaattgcggggg

SEQ ID NO: 46336 - DNA, 15 bp, Homo sapiens
aacaattgcgggggg

SEQ ID NO: 46337 - DNA, 15 bp, Homo sapiens
acaattgcggggggg

SEQ ID NO: 46338 - DNA, 15 bp, Homo sapiens
caattgcgggggggc

SEQ ID NO: 46339 - DNA, 15 bp, Homo sapiens
aattgcgggggggca

SEQ ID NO: 46340 - DNA, 15 bp, Homo sapiens
attgcgggggggcag

SEQ ID NO: 46341 - DNA, 15 bp, Homo sapiens
ttgcgggggggcagg

SEQ ID NO: 46342 - DNA, 15 bp, Homo sapiens
tgcgggggggcaggg

SEQ ID NO: 46343 - DNA, 15 bp, Homo sapiens
gcgggggggcagggg

SEQ ID NO: 46344 - DNA, 15 bp, Homo sapiens
cgggggggcaggggg

SEQ ID NO: 46345 - DNA, 15 bp, Homo sapiens
gggggggcagggggc

SEQ ID NO: 46346 - DNA, 15 bp, Homo sapiens
ggggggcagggggcg

SEQ ID NO: 46347 - DNA, 15 bp, Homo sapiens
gggggcagggggcgg

SEQ ID NO: 46348 - DNA, 15 bp, Homo sapiens
ggggcagggggcggg

SEQ ID NO: 46349 - DNA, 15 bp, Homo sapiens
gggcagggggcggga

SEQ ID NO: 46350 - DNA, 15 bp, Homo sapiens
ggcagggggcgggag

SEQ ID NO: 46351 - DNA, 15 bp, Homo sapiens
gcagggggcgggagg

SEQ ID NO: 46352 - DNA, 15 bp, Homo sapiens
cagggggcgggagga

SEQ ID NO: 46353 - DNA, 15 bp, Homo sapiens
agggggcgggaggaa

SEQ ID NO: 46354 - DNA, 15 bp, Homo sapiens
gggggcgggaggaat

SEQ ID NO: 46355 - DNA, 15 bp, Homo sapiens
ggggcgggaggaatc

SEQ ID NO: 46356 - DNA, 15 bp, Homo sapiens
gggcgggaggaatca

SEQ ID NO: 46357 - DNA, 15 bp, Homo sapiens
ggcgggaggaatcaa

SEQ ID NO: 46358 - DNA, 15 bp, Homo sapiens
gcgggaggaatcaat

SEQ ID NO: 46359 - DNA, 15 bp, Homo sapiens
cgggaggaatcaata

SEQ ID NO: 46360 - DNA, 15 bp, Homo sapiens
gggaggaatcaatag

SEQ ID NO: 46361 - DNA, 15 bp, Homo sapiens
ggaggaatcaatagt

SEQ ID NO: 46362 - DNA, 15 bp, Homo sapiens
gaggaatcaatagtg

SEQ ID NO: 46363 - DNA, 15 bp, Homo sapiens
aggaatcaatagtgg

SEQ ID NO: 46364 - DNA, 15 bp, Homo sapiens
ggaatcaatagtggc

SEQ ID NO: 46365 - DNA, 15 bp, Homo sapiens
gaatcaatagtggcg

SEQ ID NO: 46366 - DNA, 15 bp, Homo sapiens
aatcaatagtggcga

SEQ ID NO: 46367 - DNA, 15 bp, Homo sapiens
atcaatagtggcgac

SEQ ID NO: 46368 - DNA, 15 bp, Homo sapiens
tcaatagtggcgacc

SEQ ID NO: 46369 - DNA, 15 bp, Homo sapiens
caatagtggcgacca

SEQ ID NO: 46370 - DNA, 15 bp, Homo sapiens
aatagtggcgaccat

SEQ ID NO: 46371 - DNA, 15 bp, Homo sapiens
atagtggcgaccata

SEQ ID NO: 46372 - DNA, 15 bp, Homo sapiens
tagtggcgaccatac

SEQ ID NO: 46373 - DNA, 15 bp, Homo sapiens
agtggcgaccatacc

SEQ ID NO: 46374 - DNA, 15 bp, Homo sapiens
gtggcgaccataccc

SEQ ID NO: 46375 - DNA, 15 bp, Homo sapiens
tggcgaccataccct

SEQ ID NO: 46376 - DNA, 15 bp, Homo sapiens
ggcgaccataccctg

SEQ ID NO: 46377 - DNA, 15 bp, Homo sapiens
gcgaccataccctgc

SEQ ID NO: 46378 - DNA, 15 bp, Homo sapiens
cgaccataccctgct

SEQ ID NO: 46379 - DNA, 15 bp, Homo sapiens
gaccataccctgctc

SEQ ID NO: 46380 - DNA, 15 bp, Homo sapiens
accataccctgctct

SEQ ID NO: 46381 - DNA, 15 bp, Homo sapiens
ccataccctgctcta

SEQ ID NO: 46382 - DNA, 15 bp, Homo sapiens
cataccctgctctaa

SEQ ID NO: 46383 - DNA, 15 bp, Homo sapiens
ataccctgctctaag

SEQ ID NO: 46384 - DNA, 15 bp, Homo sapiens
taccctgctctaaga

SEQ ID NO: 46385 - DNA, 15 bp, Homo sapiens
accctgctctaagag

SEQ ID NO: 46386 - DNA, 15 bp, Homo sapiens
ccctgctctaagagt

SEQ ID NO: 46387 - DNA, 15 bp, Homo sapiens
cctgctctaagagtg

SEQ ID NO: 46388 - DNA, 15 bp, Homo sapiens
ctgctctaagagtgt

SEQ ID NO: 46389 - DNA, 15 bp, Homo sapiens
tgctctaagagtgtt

SEQ ID NO: 46390 - DNA, 15 bp, Homo sapiens
gctctaagagtgttt

SEQ ID NO: 46391 - DNA, 15 bp, Homo sapiens
ctctaagagtgtttt

SEQ ID NO: 46392 - DNA, 15 bp, Homo sapiens
tctaagagtgttttc

SEQ ID NO: 46393 - DNA, 15 bp, Homo sapiens
ctaagagtgttttct

SEQ ID NO: 46394 - DNA, 15 bp, Homo sapiens
taagagtgttttctc

SEQ ID NO: 46395 - DNA, 15 bp, Homo sapiens
aagagtgttttctct

SEQ ID NO: 46396 - DNA, 15 bp, Homo sapiens
agagtgttttctctt

SEQ ID NO: 46397 - DNA, 15 bp, Homo sapiens
gagtgttttctcttt

SEQ ID NO: 46398 - DNA, 15 bp, Homo sapiens
agtgttttctctttg

SEQ ID NO: 46399 - DNA, 15 bp, Homo sapiens
gtgttttctctttgg

SEQ ID NO: 46400 - DNA, 15 bp, Homo sapiens
tgttttctctttggg

SEQ ID NO: 46401 - DNA, 15 bp, Homo sapiens
gttttctctttgggc

SEQ ID NO: 46402 - DNA, 15 bp, Homo sapiens
ttttctctttgggca

SEQ ID NO: 46403 - DNA, 15 bp, Homo sapiens
tttctctttgggcag

SEQ ID NO: 46404 - DNA, 15 bp, Homo sapiens
ttctctttgggcagg

SEQ ID NO: 46405 - DNA, 15 bp, Homo sapiens
tctctttgggcaggc

SEQ ID NO: 46406 - DNA, 15 bp, Homo sapiens
ctctttgggcaggca

SEQ ID NO: 46407 - DNA, 15 bp, Homo sapiens
tctttgggcaggcat

SEQ ID NO: 46408 - DNA, 15 bp, Homo sapiens
ctttgggcaggcata

SEQ ID NO: 46409 - DNA, 15 bp, Homo sapiens
tttgggcaggcataa

SEQ ID NO: 46410 - DNA, 15 bp, Homo sapiens
ttgggcaggcataaa

SEQ ID NO: 46411 - DNA, 15 bp, Homo sapiens
tgggcaggcataaag

SEQ ID NO: 46412 - DNA, 15 bp, Homo sapiens
gggcaggcataaaga

SEQ ID NO: 46413 - DNA, 15 bp, Homo sapiens
ggcaggcataaagat

SEQ ID NO: 46414 - DNA, 15 bp, Homo sapiens
gcaggcataaagatg

SEQ ID NO: 46415 - DNA, 15 bp, Homo sapiens
caggcataaagatga

SEQ ID NO: 46416 - DNA, 15 bp, Homo sapiens
aggcataaagatgat

SEQ ID NO: 46417 - DNA, 15 bp, Homo sapiens
ggcataaagatgata

SEQ ID NO: 46418 - DNA, 15 bp, Homo sapiens
gcataaagatgataa

SEQ ID NO: 46419 - DNA, 15 bp, Homo sapiens
cataaagatgataaa

SEQ ID NO: 46420 - DNA, 15 bp, Homo sapiens
ataaagatgataaac

SEQ ID NO: 46421 - DNA, 15 bp, Homo sapiens
taaagatgataaacc

SEQ ID NO: 46422 - DNA, 15 bp, Homo sapiens
aaagatgataaacca

SEQ ID NO: 46423 - DNA, 15 bp, Homo sapiens
aagatgataaaccag

SEQ ID NO: 46424 - DNA, 15 bp, Homo sapiens
agatgataaaccagt

SEQ ID NO: 46425 - DNA, 15 bp, Homo sapiens
gatgataaaccagtg

SEQ ID NO: 46426 - DNA, 15 bp, Homo sapiens
atgataaaccagtga

SEQ ID NO: 46427 - DNA, 15 bp, Homo sapiens
tgataaaccagtgaa

SEQ ID NO: 46428 - DNA, 15 bp, Homo sapiens
gataaaccagtgaat

SEQ ID NO: 46429 - DNA, 15 bp, Homo sapiens
ataaaccagtgaatt

SEQ ID NO: 46430 - DNA, 15 bp, Homo sapiens
taaaccagtgaattg

SEQ ID NO: 46431 - DNA, 15 bp, Homo sapiens
aaaccagtgaattgt

SEQ ID NO: 46432 - DNA, 15 bp, Homo sapiens
aaccagtgaattgtc

SEQ ID NO: 46433 - DNA, 15 bp, Homo sapiens
accagtgaattgtca

SEQ ID NO: 46434 - DNA, 15 bp, Homo sapiens
ccagtgaattgtcac

SEQ ID NO: 46435 - DNA, 15 bp, Homo sapiens
cagtgaattgtcacc

SEQ ID NO: 46436 - DNA, 15 bp, Homo sapiens
agtgaattgtcacca

SEQ ID NO: 46437 - DNA, 15 bp, Homo sapiens
gtgaattgtcaccag

SEQ ID NO: 46438 - DNA, 15 bp, Homo sapiens
tgaattgtcaccagt

SEQ ID NO: 46439 - DNA, 15 bp, Homo sapiens
gaattgtcaccagta

SEQ ID NO: 46440 - DNA, 15 bp, Homo sapiens
aattgtcaccagtat

SEQ ID NO: 46441 - DNA, 15 bp, Homo sapiens
attgtcaccagtatg

SEQ ID NO: 46442 - DNA, 15 bp, Homo sapiens
ttgtcaccagtatga

SEQ ID NO: 46443 - DNA, 15 bp, Homo sapiens
tgtcaccagtatgat

SEQ ID NO: 46444 - DNA, 15 bp, Homo sapiens
gtcaccagtatgatg

SEQ ID NO: 46445 - DNA, 15 bp, Homo sapiens
tcaccagtatgatgg

SEQ ID NO: 46446 - DNA, 15 bp, Homo sapiens
caccagtatgatggt

SEQ ID NO: 46447 - DNA, 15 bp, Homo sapiens
accagtatgatggtc

SEQ ID NO: 46448 - DNA, 15 bp, Homo sapiens
ccagtatgatggtct

SEQ ID NO: 46449 - DNA, 15 bp, Homo sapiens
cagtatgatggtctg

SEQ ID NO: 46450 - DNA, 15 bp, Homo sapiens
agtatgatggtctgg

SEQ ID NO: 46451 - DNA, 15 bp, Homo sapiens
gtatgatggtctggt

SEQ ID NO: 46452 - DNA, 15 bp, Homo sapiens
tatgatggtctggta

SEQ ID NO: 46453 - DNA, 15 bp, Homo sapiens
atgatggtctggtag

SEQ ID NO: 46454 - DNA, 15 bp, Homo sapiens
tgatggtctggtaga

SEQ ID NO: 46455 - DNA, 15 bp, Homo sapiens
gatggtctggtagaa

SEQ ID NO: 46456 - DNA, 15 bp, Homo sapiens
atggtctggtagaat

SEQ ID NO: 46457 - DNA, 15 bp, Homo sapiens
tggtctggtagaatt

SEQ ID NO: 46458 - DNA, 15 bp, Homo sapiens
ggtctggtagaatta

SEQ ID NO: 46459 - DNA, 15 bp, Homo sapiens
gtctggtagaattag

SEQ ID NO: 46460 - DNA, 15 bp, Homo sapiens
tctggtagaattagc

SEQ ID NO: 46461 - DNA, 15 bp, Homo sapiens
ctggtagaattagca

SEQ ID NO: 46462 - DNA, 15 bp, Homo sapiens
tggtagaattagcaa

SEQ ID NO: 46463 - DNA, 15 bp, Homo sapiens
ggtagaattagcaac

SEQ ID NO: 46464 - DNA, 15 bp, Homo sapiens
gtagaattagcaaca

SEQ ID NO: 46465 - DNA, 15 bp, Homo sapiens
tagaattagcaacaa

SEQ ID NO: 46466 - DNA, 15 bp, Homo sapiens
agaattagcaacaat

SEQ ID NO: 46467 - DNA, 15 bp, Homo sapiens
gaattagcaacaatt

SEQ ID NO: 46468 - DNA, 15 bp, Homo sapiens
aattagcaacaattt

SEQ ID NO: 46469 - DNA, 15 bp, Homo sapiens
attagcaacaatttg

SEQ ID NO: 46470 - DNA, 15 bp, Homo sapiens
ttagcaacaatttgt

SEQ ID NO: 46471 - DNA, 15 bp, Homo sapiens
tagcaacaatttgtg

SEQ ID NO: 46472 - DNA, 15 bp, Homo sapiens
agcaacaatttgtgc

SEQ ID NO: 46473 - DNA, 15 bp, Homo sapiens
gcaacaatttgtgct

SEQ ID NO: 46474 - DNA, 15 bp, Homo sapiens
caacaatttgtgctc

SEQ ID NO: 46475 - DNA, 15 bp, Homo sapiens
aacaatttgtgctct

SEQ ID NO: 46476 - DNA, 15 bp, Homo sapiens
acaatttgtgctctt

SEQ ID NO: 46477 - DNA, 15 bp, Homo sapiens
caatttgtgctcttt

SEQ ID NO: 46478 - DNA, 15 bp, Homo sapiens
aatttgtgctctttg

SEQ ID NO: 46479 - DNA, 15 bp, Homo sapiens
atttgtgctctttgt

SEQ ID NO: 46480 - DNA, 15 bp, Homo sapiens
tttgtgctctttgta

SEQ ID NO: 46481 - DNA, 15 bp, Homo sapiens
ttgtgctctttgtaa

SEQ ID NO: 46482 - DNA, 15 bp, Homo sapiens
tgtgctctttgtaat

SEQ ID NO: 46483 - DNA, 15 bp, Homo sapiens
gtgctctttgtaatg

SEQ ID NO: 46484 - DNA, 15 bp, Homo sapiens
tgctctttgtaatga

SEQ ID NO: 46485 - DNA, 15 bp, Homo sapiens
gctctttgtaatgac

SEQ ID NO: 46486 - DNA, 15 bp, Homo sapiens
ctctttgtaatgact

SEQ ID NO: 46487 - DNA, 15 bp, Homo sapiens
tctttgtaatgactc

SEQ ID NO: 46488 - DNA, 15 bp, Homo sapiens
ctttgtaatgactct

SEQ ID NO: 46489 - DNA, 15 bp, Homo sapiens
tttgtaatgactctg

SEQ ID NO: 46490 - DNA, 15 bp, Homo sapiens
ttgtaatgactctgc

SEQ ID NO: 46491 - DNA, 15 bp, Homo sapiens
tgtaatgactctgct

SEQ ID NO: 46492 - DNA, 15 bp, Homo sapiens
gtaatgactctgctt

SEQ ID NO: 46493 - DNA, 15 bp, Homo sapiens
taatgactctgcttt

SEQ ID NO: 46494 - DNA, 15 bp, Homo sapiens
aatgactctgctttg

SEQ ID NO: 46495 - DNA, 15 bp, Homo sapiens
atgactctgctttgg

SEQ ID NO: 46496 - DNA, 15 bp, Homo sapiens
tgactctgctttgga

SEQ ID NO: 46497 - DNA, 15 bp, Homo sapiens
gactctgctttggat

SEQ ID NO: 46498 - DNA, 15 bp, Homo sapiens
actctgctttggatt

SEQ ID NO: 46499 - DNA, 15 bp, Homo sapiens
ctctgctttggatta

SEQ ID NO: 46500 - DNA, 15 bp, Homo sapiens
tctgctttggattac

SEQ ID NO: 46501 - DNA, 15 bp, Homo sapiens
ctgctttggattaca

SEQ ID NO: 46502 - DNA, 15 bp, Homo sapiens
tgctttggattacaa

SEQ ID NO: 46503 - DNA, 15 bp, Homo sapiens
gctttggattacaat

SEQ ID NO: 46504 - DNA, 15 bp, Homo sapiens
ctttggattacaatg

SEQ ID NO: 46505 - DNA, 15 bp, Homo sapiens
tttggattacaatga

SEQ ID NO: 46506 - DNA, 15 bp, Homo sapiens
ttggattacaatgag

SEQ ID NO: 46507 - DNA, 15 bp, Homo sapiens
tggattacaatgagg

SEQ ID NO: 46508 - DNA, 15 bp, Homo sapiens
ggattacaatgaggt

SEQ ID NO: 46509 - DNA, 15 bp, Homo sapiens
gattacaatgaggta

SEQ ID NO: 46510 - DNA, 15 bp, Homo sapiens
attacaatgaggtaa

SEQ ID NO: 46511 - DNA, 15 bp, Homo sapiens
ttacaatgaggtaag

SEQ ID NO: 46512 - DNA, 15 bp, Homo sapiens
tacaatgaggtaagt

SEQ ID NO: 46513 - DNA, 15 bp, Homo sapiens
acaatgaggtaagtc

SEQ ID NO: 46514 - DNA, 15 bp, Homo sapiens
caatgaggtaagtct

SEQ ID NO: 46515 - DNA, 15 bp, Homo sapiens
aatgaggtaagtctc

SEQ ID NO: 46516 - DNA, 15 bp, Homo sapiens
atgaggtaagtctct

SEQ ID NO: 46517 - DNA, 15 bp, Homo sapiens
tgaggtaagtctctt

SEQ ID NO: 46518 - DNA, 15 bp, Homo sapiens
gaggtaagtctcttc

SEQ ID NO: 46519 - DNA, 15 bp, Homo sapiens
aggtaagtctcttca

SEQ ID NO: 46520 - DNA, 15 bp, Homo sapiens
ggtaagtctcttcat

SEQ ID NO: 46521 - DNA, 15 bp, Homo sapiens
gtaagtctcttcata

SEQ ID NO: 46522 - DNA, 15 bp, Homo sapiens
taagtctcttcataa

SEQ ID NO: 46523 - DNA, 15 bp, Homo sapiens
aagtctcttcataaa

SEQ ID NO: 46524 - DNA, 15 bp, Homo sapiens
agtctcttcataaat

SEQ ID NO: 46525 - DNA, 15 bp, Homo sapiens
gtctcttcataaatt

SEQ ID NO: 46526 - DNA, 15 bp, Homo sapiens
tctcttcataaatta

SEQ ID NO: 46527 - DNA, 15 bp, Homo sapiens
ctcttcataaattag

SEQ ID NO: 46528 - DNA, 15 bp, Homo sapiens
tcttcataaattaga

SEQ ID NO: 46529 - DNA, 15 bp, Homo sapiens
cttcataaattagaa

SEQ ID NO: 46530 - DNA, 15 bp, Homo sapiens
ttcataaattagaag

SEQ ID NO: 46531 - DNA, 15 bp, Homo sapiens
tcataaattagaagg

SEQ ID NO: 46532 - DNA, 15 bp, Homo sapiens
cataaattagaagga

SEQ ID NO: 46533 - DNA, 15 bp, Homo sapiens
ataaattagaaggaa

SEQ ID NO: 46534 - DNA, 15 bp, Homo sapiens
taaattagaaggaat

SEQ ID NO: 46535 - DNA, 15 bp, Homo sapiens
aaattagaaggaatg

SEQ ID NO: 46536 - DNA, 15 bp, Homo sapiens
aattagaaggaatgg

SEQ ID NO: 46537 - DNA, 15 bp, Homo sapiens
attagaaggaatggc

SEQ ID NO: 46538 - DNA, 15 bp, Homo sapiens
ttagaaggaatggct

SEQ ID NO: 46539 - DNA, 15 bp, Homo sapiens
tagaaggaatggctg

SEQ ID NO: 46540 - DNA, 15 bp, Homo sapiens
agaaggaatggctgt

SEQ ID NO: 46541 - DNA, 15 bp, Homo sapiens
gaaggaatggctgtt

SEQ ID NO: 46542 - DNA, 15 bp, Homo sapiens
aaggaatggctgttc

SEQ ID NO: 46543 - DNA, 15 bp, Homo sapiens
aggaatggctgttcc

SEQ ID NO: 46544 - DNA, 15 bp, Homo sapiens
ggaatggctgttcct

SEQ ID NO: 46545 - DNA, 15 bp, Homo sapiens
gaatggctgttccta

SEQ ID NO: 46546 - DNA, 15 bp, Homo sapiens
aatggctgttcctag

SEQ ID NO: 46547 - DNA, 15 bp, Homo sapiens
atggctgttcctagt

SEQ ID NO: 46548 - DNA, 15 bp, Homo sapiens
tggctgttcctagtt

SEQ ID NO: 46549 - DNA, 15 bp, Homo sapiens
ggctgttcctagttc

SEQ ID NO: 46550 - DNA, 15 bp, Homo sapiens
gctgttcctagttca

SEQ ID NO: 46551 - DNA, 15 bp, Homo sapiens
ctgttcctagttcaa

SEQ ID NO: 46552 - DNA, 15 bp, Homo sapiens
tgttcctagttcaag

SEQ ID NO: 46553 - DNA, 15 bp, Homo sapiens
gttcctagttcaagg

SEQ ID NO: 46554 - DNA, 15 bp, Homo sapiens
ttcctagttcaaggg

SEQ ID NO: 46555 - DNA, 15 bp, Homo sapiens
tcctagttcaagggt

SEQ ID NO: 46556 - DNA, 15 bp, Homo sapiens
cctagttcaagggtg

SEQ ID NO: 46557 - DNA, 15 bp, Homo sapiens
ctagttcaagggtgg

SEQ ID NO: 46558 - DNA, 15 bp, Homo sapiens
tagttcaagggtggg

SEQ ID NO: 46559 - DNA, 15 bp, Homo sapiens
agttcaagggtgggg

SEQ ID NO: 46560 - DNA, 15 bp, Homo sapiens
gttcaagggtggggt

SEQ ID NO: 46561 - DNA, 15 bp, Homo sapiens
ttcaagggtggggtg

SEQ ID NO: 46562 - DNA, 15 bp, Homo sapiens
tcaagggtggggtgg

SEQ ID NO: 46563 - DNA, 15 bp, Homo sapiens
caagggtggggtggg

SEQ ID NO: 46564 - DNA, 15 bp, Homo sapiens
aagggtggggtgggt

SEQ ID NO: 46565 - DNA, 15 bp, Homo sapiens
agggtggggtgggtg

SEQ ID NO: 46566 - DNA, 15 bp, Homo sapiens
gggtggggtgggtgg

SEQ ID NO: 46567 - DNA, 15 bp, Homo sapiens
ggtggggtgggtgga

SEQ ID NO: 46568 - DNA, 15 bp, Homo sapiens
gtggggtgggtggaa

SEQ ID NO: 46569 - DNA, 15 bp, Homo sapiens
tggggtgggtggaat

SEQ ID NO: 46570 - DNA, 15 bp, Homo sapiens
ggggtgggtggaatg

SEQ ID NO: 46571 - DNA, 15 bp, Homo sapiens
gggtgggtggaatga

SEQ ID NO: 46572 - DNA, 15 bp, Homo sapiens
ggtgggtggaatgaa

SEQ ID NO: 46573 - DNA, 15 bp, Homo sapiens
gtgggtggaatgaaa

SEQ ID NO: 46574 - DNA, 15 bp, Homo sapiens
tgggtggaatgaaag

SEQ ID NO: 46575 - DNA, 15 bp, Homo sapiens
gggtggaatgaaagt

SEQ ID NO: 46576 - DNA, 15 bp, Homo sapiens
ggtggaatgaaagtc

SEQ ID NO: 46577 - DNA, 15 bp, Homo sapiens
gtggaatgaaagtct

SEQ ID NO: 46578 - DNA, 15 bp, Homo sapiens
tggaatgaaagtcta

SEQ ID NO: 46579 - DNA, 15 bp, Homo sapiens
ggaatgaaagtctag

SEQ ID NO: 46580 - DNA, 15 bp, Homo sapiens
gaatgaaagtctagc

SEQ ID NO: 46581 - DNA, 15 bp, Homo sapiens
aatgaaagtctagcc

SEQ ID NO: 46582 - DNA, 15 bp, Homo sapiens
atgaaagtctagcct

SEQ ID NO: 46583 - DNA, 15 bp, Homo sapiens
tgaaagtctagcctg

SEQ ID NO: 46584 - DNA, 15 bp, Homo sapiens
gaaagtctagcctgc

SEQ ID NO: 46585 - DNA, 15 bp, Homo sapiens
aaagtctagcctgcc

SEQ ID NO: 46586 - DNA, 15 bp, Homo sapiens
aagtctagcctgcct

SEQ ID NO: 46587 - DNA, 15 bp, Homo sapiens
agtctagcctgcctt

SEQ ID NO: 46588 - DNA, 15 bp, Homo sapiens
gtctagcctgccttc

SEQ ID NO: 46589 - DNA, 15 bp, Homo sapiens
tctagcctgccttcc

SEQ ID NO: 46590 - DNA, 15 bp, Homo sapiens
ctagcctgccttcct

SEQ ID NO: 46591 - DNA, 15 bp, Homo sapiens
tagcctgccttcctc

SEQ ID NO: 46592 - DNA, 15 bp, Homo sapiens
agcctgccttcctcc

SEQ ID NO: 46593 - DNA, 15 bp, Homo sapiens
gcctgccttcctccc

SEQ ID NO: 46594 - DNA, 15 bp, Homo sapiens
cctgccttcctccct

SEQ ID NO: 46595 - DNA, 15 bp, Homo sapiens
ctgccttcctccctt

SEQ ID NO: 46596 - DNA, 15 bp, Homo sapiens
tgccttcctcccttt

SEQ ID NO: 46597 - DNA, 15 bp, Homo sapiens
gccttcctccctttt

SEQ ID NO: 46598 - DNA, 15 bp, Homo sapiens
ccttcctcccttttg

SEQ ID NO: 46599 - DNA, 15 bp, Homo sapiens
cttcctcccttttga

SEQ ID NO: 46600 - DNA, 15 bp, Homo sapiens
ttcctcccttttgaa

SEQ ID NO: 46601 - DNA, 15 bp, Homo sapiens
tcctcccttttgaaa

SEQ ID NO: 46602 - DNA, 15 bp, Homo sapiens
cctcccttttgaaag

SEQ ID NO: 46603 - DNA, 15 bp, Homo sapiens
ctcccttttgaaagt

SEQ ID NO: 46604 - DNA, 15 bp, Homo sapiens
tcccttttgaaagtc

SEQ ID NO: 46605 - DNA, 15 bp, Homo sapiens
cccttttgaaagtca

SEQ ID NO: 46606 - DNA, 15 bp, Homo sapiens
ccttttgaaagtcaa

SEQ ID NO: 46607 - DNA, 15 bp, Homo sapiens
cttttgaaagtcaag

SEQ ID NO: 46608 - DNA, 15 bp, Homo sapiens
ttttgaaagtcaagg

SEQ ID NO: 46609 - DNA, 15 bp, Homo sapiens
tttgaaagtcaaggg

SEQ ID NO: 46610 - DNA, 15 bp, Homo sapiens
ttgaaagtcaagggt

SEQ ID NO: 46611 - DNA, 15 bp, Homo sapiens
tgaaagtcaagggtg

SEQ ID NO: 46612 - DNA, 15 bp, Homo sapiens
gaaagtcaagggtgc

SEQ ID NO: 46613 - DNA, 15 bp, Homo sapiens
aaagtcaagggtgcc

SEQ ID NO: 46614 - DNA, 15 bp, Homo sapiens
aagtcaagggtgcct

SEQ ID NO: 46615 - DNA, 15 bp, Homo sapiens
agtcaagggtgcctg

SEQ ID NO: 46616 - DNA, 15 bp, Homo sapiens
gtcaagggtgcctga

SEQ ID NO: 46617 - DNA, 15 bp, Homo sapiens
tcaagggtgcctgat

SEQ ID NO: 46618 - DNA, 15 bp, Homo sapiens
caagggtgcctgatt

SEQ ID NO: 46619 - DNA, 15 bp, Homo sapiens
aagggtgcctgattt

SEQ ID NO: 46620 - DNA, 15 bp, Homo sapiens
agggtgcctgatttt

SEQ ID NO: 46621 - DNA, 15 bp, Homo sapiens
gggtgcctgattttg

SEQ ID NO: 46622 - DNA, 15 bp, Homo sapiens
ggtgcctgattttgt

SEQ ID NO: 46623 - DNA, 15 bp, Homo sapiens
gtgcctgattttgtt

SEQ ID NO: 46624 - DNA, 15 bp, Homo sapiens
tgcctgattttgttt

SEQ ID NO: 46625 - DNA, 15 bp, Homo sapiens
gcctgattttgtttc

SEQ ID NO: 46626 - DNA, 15 bp, Homo sapiens
cctgattttgtttcc

SEQ ID NO: 46627 - DNA, 15 bp, Homo sapiens
ctgattttgtttccc

SEQ ID NO: 46628 - DNA, 15 bp, Homo sapiens
tgattttgtttcccc

SEQ ID NO: 46629 - DNA, 15 bp, Homo sapiens
gattttgtttccccc

SEQ ID NO: 46630 - DNA, 15 bp, Homo sapiens
attttgtttccccct

SEQ ID NO: 46631 - DNA, 15 bp, Homo sapiens
ttttgtttccccctt

SEQ ID NO: 46632 - DNA, 15 bp, Homo sapiens
tttgtttcccccttc

SEQ ID NO: 46633 - DNA, 15 bp, Homo sapiens
ttgtttcccccttcc

SEQ ID NO: 46634 - DNA, 15 bp, Homo sapiens
tgtttcccccttcca

SEQ ID NO: 46635 - DNA, 15 bp, Homo sapiens
gtttcccccttccat

SEQ ID NO: 46636 - DNA, 15 bp, Homo sapiens
tttcccccttccatt

SEQ ID NO: 46637 - DNA, 15 bp, Homo sapiens
ttcccccttccattc

SEQ ID NO: 46638 - DNA, 15 bp, Homo sapiens
tcccccttccattca

SEQ ID NO: 46639 - DNA, 15 bp, Homo sapiens
cccccttccattcag

SEQ ID NO: 46640 - DNA, 15 bp, Homo sapiens
ccccttccattcaga

SEQ ID NO: 46641 - DNA, 15 bp, Homo sapiens
cccttccattcagaa

SEQ ID NO: 46642 - DNA, 15 bp, Homo sapiens
ccttccattcagaac

SEQ ID NO: 46643 - DNA, 15 bp, Homo sapiens
cttccattcagaacc

SEQ ID NO: 46644 - DNA, 15 bp, Homo sapiens
ttccattcagaacct

SEQ ID NO: 46645 - DNA, 15 bp, Homo sapiens
tccattcagaacctg

SEQ ID NO: 46646 - DNA, 15 bp, Homo sapiens
ccattcagaacctga

SEQ ID NO: 46647 - DNA, 15 bp, Homo sapiens
cattcagaacctgat

SEQ ID NO: 46648 - DNA, 15 bp, Homo sapiens
attcagaacctgatg

SEQ ID NO: 46649 - DNA, 15 bp, Homo sapiens
ttcagaacctgatgg

SEQ ID NO: 46650 - DNA, 15 bp, Homo sapiens
tcagaacctgatggt

SEQ ID NO: 46651 - DNA, 15 bp, Homo sapiens
cagaacctgatggtg

SEQ ID NO: 46652 - DNA, 15 bp, Homo sapiens
agaacctgatggtgg

SEQ ID NO: 46653 - DNA, 15 bp, Homo sapiens
gaacctgatggtggg

SEQ ID NO: 46654 - DNA, 15 bp, Homo sapiens
aacctgatggtgggg

SEQ ID NO: 46655 - DNA, 15 bp, Homo sapiens
acctgatggtggggc

SEQ ID NO: 46656 - DNA, 15 bp, Homo sapiens
cctgatggtggggcc

SEQ ID NO: 46657 - DNA, 15 bp, Homo sapiens
ctgatggtggggcca

SEQ ID NO: 46658 - DNA, 15 bp, Homo sapiens
tgatggtggggccag

SEQ ID NO: 46659 - DNA, 15 bp, Homo sapiens
gatggtggggccagc

SEQ ID NO: 46660 - DNA, 15 bp, Homo sapiens
atggtggggccagca

SEQ ID NO: 46661 - DNA, 15 bp, Homo sapiens
tggtggggccagcat

SEQ ID NO: 46662 - DNA, 15 bp, Homo sapiens
ggtggggccagcatg

SEQ ID NO: 46663 - DNA, 15 bp, Homo sapiens
gtggggccagcatga

SEQ ID NO: 46664 - DNA, 15 bp, Homo sapiens
tggggccagcatgac

SEQ ID NO: 46665 - DNA, 15 bp, Homo sapiens
ggggccagcatgacc

SEQ ID NO: 46666 - DNA, 15 bp, Homo sapiens
gggccagcatgacct

SEQ ID NO: 46667 - DNA, 15 bp, Homo sapiens
ggccagcatgacctc

SEQ ID NO: 46668 - DNA, 15 bp, Homo sapiens
gccagcatgacctca

SEQ ID NO: 46669 - DNA, 15 bp, Homo sapiens
ccagcatgacctcac

SEQ ID NO: 46670 - DNA, 15 bp, Homo sapiens
cagcatgacctcacc

SEQ ID NO: 46671 - DNA, 15 bp, Homo sapiens
agcatgacctcacca

SEQ ID NO: 46672 - DNA, 15 bp, Homo sapiens
gcatgacctcaccaa

SEQ ID NO: 46673 - DNA, 15 bp, Homo sapiens
catgacctcaccaaa

SEQ ID NO: 46674 - DNA, 15 bp, Homo sapiens
atgacctcaccaaag

SEQ ID NO: 46675 - DNA, 15 bp, Homo sapiens
tgacctcaccaaaga

SEQ ID NO: 46676 - DNA, 15 bp, Homo sapiens
gacctcaccaaagaa

SEQ ID NO: 46677 - DNA, 15 bp, Homo sapiens
acctcaccaaagaaa

SEQ ID NO: 46678 - DNA, 15 bp, Homo sapiens
cctcaccaaagaaag

SEQ ID NO: 46679 - DNA, 15 bp, Homo sapiens
ctcaccaaagaaagc

SEQ ID NO: 46680 - DNA, 15 bp, Homo sapiens
tcaccaaagaaagct

SEQ ID NO: 46681 - DNA, 15 bp, Homo sapiens
caccaaagaaagctg

SEQ ID NO: 46682 - DNA, 15 bp, Homo sapiens
accaaagaaagctga

SEQ ID NO: 46683 - DNA, 15 bp, Homo sapiens
ccaaagaaagctgag

SEQ ID NO: 46684 - DNA, 15 bp, Homo sapiens
caaagaaagctgaga

SEQ ID NO: 46685 - DNA, 15 bp, Homo sapiens
aaagaaagctgagag

SEQ ID NO: 46686 - DNA, 15 bp, Homo sapiens
aagaaagctgagagc

SEQ ID NO: 46687 - DNA, 15 bp, Homo sapiens
agaaagctgagagcc

SEQ ID NO: 46688 - DNA, 15 bp, Homo sapiens
gaaagctgagagcct

SEQ ID NO: 46689 - DNA, 15 bp, Homo sapiens
aaagctgagagcctt

SEQ ID NO: 46690 - DNA, 15 bp, Homo sapiens
aagctgagagccttt

SEQ ID NO: 46691 - DNA, 15 bp, Homo sapiens
agctgagagcctttc

SEQ ID NO: 46692 - DNA, 15 bp, Homo sapiens
gctgagagcctttca

SEQ ID NO: 46693 - DNA, 15 bp, Homo sapiens
ctgagagcctttcac

SEQ ID NO: 46694 - DNA, 15 bp, Homo sapiens
tgagagcctttcaca

SEQ ID NO: 46695 - DNA, 15 bp, Homo sapiens
gagagcctttcacat

SEQ ID NO: 46696 - DNA, 15 bp, Homo sapiens
agagcctttcacata

SEQ ID NO: 46697 - DNA, 15 bp, Homo sapiens
gagcctttcacatat

SEQ ID NO: 46698 - DNA, 15 bp, Homo sapiens
agcctttcacatatc

SEQ ID NO: 46699 - DNA, 15 bp, Homo sapiens
gcctttcacatatcc

SEQ ID NO: 46700 - DNA, 15 bp, Homo sapiens
cctttcacatatcct

SEQ ID NO: 46701 - DNA, 15 bp, Homo sapiens
ctttcacatatcctc

SEQ ID NO: 46702 - DNA, 15 bp, Homo sapiens
tttcacatatcctct

SEQ ID NO: 46703 - DNA, 15 bp, Homo sapiens
ttcacatatcctctg

SEQ ID NO: 46704 - DNA, 15 bp, Homo sapiens
tcacatatcctctgt

SEQ ID NO: 46705 - DNA, 15 bp, Homo sapiens
cacatatcctctgtg

SEQ ID NO: 46706 - DNA, 15 bp, Homo sapiens
acatatcctctgtga

SEQ ID NO: 46707 - DNA, 15 bp, Homo sapiens
catatcctctgtgac

SEQ ID NO: 46708 - DNA, 15 bp, Homo sapiens
atatcctctgtgact

SEQ ID NO: 46709 - DNA, 15 bp, Homo sapiens
tatcctctgtgactg

SEQ ID NO: 46710 - DNA, 15 bp, Homo sapiens
atcctctgtgactga

SEQ ID NO: 46711 - DNA, 15 bp, Homo sapiens
tcctctgtgactgag

SEQ ID NO: 46712 - DNA, 15 bp, Homo sapiens
cctctgtgactgagc

SEQ ID NO: 46713 - DNA, 15 bp, Homo sapiens
ctctgtgactgagca

SEQ ID NO: 46714 - DNA, 15 bp, Homo sapiens
tctgtgactgagcat

SEQ ID NO: 46715 - DNA, 15 bp, Homo sapiens
ctgtgactgagcatt

SEQ ID NO: 46716 - DNA, 15 bp, Homo sapiens
tgtgactgagcattg

SEQ ID NO: 46717 - DNA, 15 bp, Homo sapiens
gtgactgagcattgc

SEQ ID NO: 46718 - DNA, 15 bp, Homo sapiens
tgactgagcattgca

SEQ ID NO: 46719 - DNA, 15 bp, Homo sapiens
gactgagcattgcag

SEQ ID NO: 46720 - DNA, 15 bp, Homo sapiens
actgagcattgcagt

SEQ ID NO: 46721 - DNA, 15 bp, Homo sapiens
ctgagcattgcagtt

SEQ ID NO: 46722 - DNA, 15 bp, Homo sapiens
tgagcattgcagtta

SEQ ID NO: 46723 - DNA, 15 bp, Homo sapiens
gagcattgcagttag

SEQ ID NO: 46724 - DNA, 15 bp, Homo sapiens
agcattgcagttagt

SEQ ID NO: 46725 - DNA, 15 bp, Homo sapiens
gcattgcagttagtt

SEQ ID NO: 46726 - DNA, 15 bp, Homo sapiens
cattgcagttagtta

SEQ ID NO: 46727 - DNA, 15 bp, Homo sapiens
attgcagttagttaa

SEQ ID NO: 46728 - DNA, 15 bp, Homo sapiens
ttgcagttagttaac

SEQ ID NO: 46729 - DNA, 15 bp, Homo sapiens
tgcagttagttaact

SEQ ID NO: 46730 - DNA, 15 bp, Homo sapiens
gcagttagttaactt

SEQ ID NO: 46731 - DNA, 15 bp, Homo sapiens
cagttagttaactta

SEQ ID NO: 46732 - DNA, 15 bp, Homo sapiens
agttagttaacttaa

SEQ ID NO: 46733 - DNA, 15 bp, Homo sapiens
gttagttaacttaaa

SEQ ID NO: 46734 - DNA, 15 bp, Homo sapiens
ttagttaacttaaag

SEQ ID NO: 46735 - DNA, 15 bp, Homo sapiens
tagttaacttaaagt

SEQ ID NO: 46736 - DNA, 15 bp, Homo sapiens
agttaacttaaagtt

SEQ ID NO: 46737 - DNA, 15 bp, Homo sapiens
gttaacttaaagttg

SEQ ID NO: 46738 - DNA, 15 bp, Homo sapiens
ttaacttaaagttgt

SEQ ID NO: 46739 - DNA, 15 bp, Homo sapiens
taacttaaagttgta

SEQ ID NO: 46740 - DNA, 15 bp, Homo sapiens
aacttaaagttgtag

SEQ ID NO: 46741 - DNA, 15 bp, Homo sapiens
acttaaagttgtagt

SEQ ID NO: 46742 - DNA, 15 bp, Homo sapiens
cttaaagttgtagta

SEQ ID NO: 46743 - DNA, 15 bp, Homo sapiens
ttaaagttgtagtat

SEQ ID NO: 46744 - DNA, 15 bp, Homo sapiens
taaagttgtagtata

SEQ ID NO: 46745 - DNA, 15 bp, Homo sapiens
aaagttgtagtatat

SEQ ID NO: 46746 - DNA, 15 bp, Homo sapiens
aagttgtagtatatg

SEQ ID NO: 46747 - DNA, 15 bp, Homo sapiens
agttgtagtatatgt

SEQ ID NO: 46748 - DNA, 15 bp, Homo sapiens
gttgtagtatatgtg

SEQ ID NO: 46749 - DNA, 15 bp, Homo sapiens
ttgtagtatatgtga

SEQ ID NO: 46750 - DNA, 15 bp, Homo sapiens
tgtagtatatgtgat

SEQ ID NO: 46751 - DNA, 15 bp, Homo sapiens
gtagtatatgtgatg

SEQ ID NO: 46752 - DNA, 15 bp, Homo sapiens
tagtatatgtgatgt

SEQ ID NO: 46753 - DNA, 15 bp, Homo sapiens
agtatatgtgatgtt

SEQ ID NO: 46754 - DNA, 15 bp, Homo sapiens
gtatatgtgatgttc

SEQ ID NO: 46755 - DNA, 15 bp, Homo sapiens
tatatgtgatgttct

SEQ ID NO: 46756 - DNA, 15 bp, Homo sapiens
atatgtgatgttctt

SEQ ID NO: 46757 - DNA, 15 bp, Homo sapiens
tatgtgatgttcttt

SEQ ID NO: 46758 - DNA, 15 bp, Homo sapiens
atgtgatgttctttc

SEQ ID NO: 46759 - DNA, 15 bp, Homo sapiens
tgtgatgttctttct

SEQ ID NO: 46760 - DNA, 15 bp, Homo sapiens
gtgatgttctttctg

SEQ ID NO: 46761 - DNA, 15 bp, Homo sapiens
tgatgttctttctgt

SEQ ID NO: 46762 - DNA, 15 bp, Homo sapiens
gatgttctttctgtt

SEQ ID NO: 46763 - DNA, 15 bp, Homo sapiens
atgttctttctgttg

SEQ ID NO: 46764 - DNA, 15 bp, Homo sapiens
tgttctttctgttga

SEQ ID NO: 46765 - DNA, 15 bp, Homo sapiens
gttctttctgttgat

SEQ ID NO: 46766 - DNA, 15 bp, Homo sapiens
ttctttctgttgata

SEQ ID NO: 46767 - DNA, 15 bp, Homo sapiens
tctttctgttgatag

SEQ ID NO: 46768 - DNA, 15 bp, Homo sapiens
ctttctgttgatagc

SEQ ID NO: 46769 - DNA, 15 bp, Homo sapiens
tttctgttgatagca

SEQ ID NO: 46770 - DNA, 15 bp, Homo sapiens
ttctgttgatagcat

SEQ ID NO: 46771 - DNA, 15 bp, Homo sapiens
tctgttgatagcata

SEQ ID NO: 46772 - DNA, 15 bp, Homo sapiens
ctgttgatagcatac

SEQ ID NO: 46773 - DNA, 15 bp, Homo sapiens
tgttgatagcatact

SEQ ID NO: 46774 - DNA, 15 bp, Homo sapiens
gttgatagcatactt

SEQ ID NO: 46775 - DNA, 15 bp, Homo sapiens
ttgatagcatactta

SEQ ID NO: 46776 - DNA, 15 bp, Homo sapiens
tgatagcatacttac

SEQ ID NO: 46777 - DNA, 15 bp, Homo sapiens
gatagcatacttact

SEQ ID NO: 46778 - DNA, 15 bp, Homo sapiens
atagcatacttacta

SEQ ID NO: 46779 - DNA, 15 bp, Homo sapiens
tagcatacttactat

SEQ ID NO: 46780 - DNA, 15 bp, Homo sapiens
agcatacttactata

SEQ ID NO: 46781 - DNA, 15 bp, Homo sapiens
gcatacttactataa

SEQ ID NO: 46782 - DNA, 15 bp, Homo sapiens
catacttactataaa

SEQ ID NO: 46783 - DNA, 15 bp, Homo sapiens
atacttactataaat

SEQ ID NO: 46784 - DNA, 15 bp, Homo sapiens
tacttactataaatg

SEQ ID NO: 46785 - DNA, 15 bp, Homo sapiens
acttactataaatga

SEQ ID NO: 46786 - DNA, 15 bp, Homo sapiens
cttactataaatgaa

SEQ ID NO: 46787 - DNA, 15 bp, Homo sapiens
ttactataaatgaat

SEQ ID NO: 46788 - DNA, 15 bp, Homo sapiens
tactataaatgaata

SEQ ID NO: 46789 - DNA, 15 bp, Homo sapiens
actataaatgaataa

SEQ ID NO: 46790 - DNA, 15 bp, Homo sapiens
ctataaatgaataaa

SEQ ID NO: 46791 - DNA, 15 bp, Homo sapiens
tataaatgaataaaa

SEQ ID NO: 46792 - DNA, 15 bp, Homo sapiens
ataaatgaataaaac

SEQ ID NO: 46793 - DNA, 15 bp, Homo sapiens
taaatgaataaaacc

SEQ ID NO: 46794 - DNA, 15 bp, Homo sapiens
aaatgaataaaaccc

SEQ ID NO: 46795 - DNA, 15 bp, Homo sapiens
aatgaataaaaccca

SEQ ID NO: 46796 - DNA, 15 bp, Homo sapiens
atgaataaaacccag

SEQ ID NO: 46797 - DNA, 15 bp, Homo sapiens
tgaataaaacccagg

SEQ ID NO: 46798 - DNA, 15 bp, Homo sapiens
gaataaaacccagga

SEQ ID NO: 46799 - DNA, 15 bp, Homo sapiens
aataaaacccaggat

SEQ ID NO: 46800 - DNA, 15 bp, Homo sapiens
ataaaacccaggata

SEQ ID NO: 46801 - DNA, 15 bp, Homo sapiens
taaaacccaggatag

SEQ ID NO: 46802 - DNA, 15 bp, Homo sapiens
aaaacccaggataga

SEQ ID NO: 46803 - DNA, 15 bp, Homo sapiens
aaacccaggatagaa

SEQ ID NO: 46804 - DNA, 15 bp, Homo sapiens
aacccaggatagaaa

SEQ ID NO: 46805 - DNA, 15 bp, Homo sapiens
acccaggatagaaaa

SEQ ID NO: 46806 - DNA, 15 bp, Homo sapiens
cccaggatagaaaat

SEQ ID NO: 46807 - DNA, 15 bp, Homo sapiens
ccaggatagaaaatg

SEQ ID NO: 46808 - DNA, 15 bp, Homo sapiens
caggatagaaaatgc

SEQ ID NO: 46809 - DNA, 15 bp, Homo sapiens
aggatagaaaatgct

SEQ ID NO: 46810 - DNA, 15 bp, Homo sapiens
ggatagaaaatgctt

SEQ ID NO: 46811 - DNA, 15 bp, Homo sapiens
gatagaaaatgcttt

SEQ ID NO: 46812 - DNA, 15 bp, Homo sapiens
atagaaaatgctttc

SEQ ID NO: 46813 - DNA, 15 bp, Homo sapiens
tagaaaatgctttcc

SEQ ID NO: 46814 - DNA, 15 bp, Homo sapiens
agaaaatgctttcct

SEQ ID NO: 46815 - DNA, 15 bp, Homo sapiens
gaaaatgctttcctg

SEQ ID NO: 46816 - DNA, 15 bp, Homo sapiens
aaaatgctttcctga

SEQ ID NO: 46817 - DNA, 15 bp, Homo sapiens
aaatgctttcctgaa

SEQ ID NO: 46818 - DNA, 15 bp, Homo sapiens
aatgctttcctgaaa

SEQ ID NO: 46819 - DNA, 15 bp, Homo sapiens
atgctttcctgaaag

SEQ ID NO: 46820 - DNA, 15 bp, Homo sapiens
tgctttcctgaaagc

SEQ ID NO: 46821 - DNA, 15 bp, Homo sapiens
gctttcctgaaagca

SEQ ID NO: 46822 - DNA, 15 bp, Homo sapiens
ctttcctgaaagcaa

SEQ ID NO: 46823 - DNA, 15 bp, Homo sapiens
tttcctgaaagcaaa

SEQ ID NO: 46824 - DNA, 15 bp, Homo sapiens
ttcctgaaagcaaag

SEQ ID NO: 46825 - DNA, 15 bp, Homo sapiens
tcctgaaagcaaagg

SEQ ID NO: 46826 - DNA, 15 bp, Homo sapiens
cctgaaagcaaagga

SEQ ID NO: 46827 - DNA, 15 bp, Homo sapiens
ctgaaagcaaaggat

SEQ ID NO: 46828 - DNA, 15 bp, Homo sapiens
tgaaagcaaaggata

SEQ ID NO: 46829 - DNA, 15 bp, Homo sapiens
gaaagcaaaggatat

SEQ ID NO: 46830 - DNA, 15 bp, Homo sapiens
aaagcaaaggatata

SEQ ID NO: 46831 - DNA, 15 bp, Homo sapiens
aagcaaaggatatag

SEQ ID NO: 46832 - DNA, 15 bp, Homo sapiens
agcaaaggatatagt

SEQ ID NO: 46833 - DNA, 15 bp, Homo sapiens
gcaaaggatatagtt

SEQ ID NO: 46834 - DNA, 15 bp, Homo sapiens
caaaggatatagttt

SEQ ID NO: 46835 - DNA, 15 bp, Homo sapiens
aaaggatatagtttc

SEQ ID NO: 46836 - DNA, 15 bp, Homo sapiens
aaggatatagtttct

SEQ ID NO: 46837 - DNA, 15 bp, Homo sapiens
aggatatagtttctg

SEQ ID NO: 46838 - DNA, 15 bp, Homo sapiens
ggatatagtttctgt

SEQ ID NO: 46839 - DNA, 15 bp, Homo sapiens
gatatagtttctgtc

SEQ ID NO: 46840 - DNA, 15 bp, Homo sapiens
atatagtttctgtct

SEQ ID NO: 46841 - DNA, 15 bp, Homo sapiens
tatagtttctgtctc

SEQ ID NO: 46842 - DNA, 15 bp, Homo sapiens
atagtttctgtctca

SEQ ID NO: 46843 - DNA, 15 bp, Homo sapiens
tagtttctgtctcaa

SEQ ID NO: 46844 - DNA, 15 bp, Homo sapiens
agtttctgtctcaaa

SEQ ID NO: 46845 - DNA, 15 bp, Homo sapiens
gtttctgtctcaaag

SEQ ID NO: 46846 - DNA, 15 bp, Homo sapiens
tttctgtctcaaagg

SEQ ID NO: 46847 - DNA, 15 bp, Homo sapiens
ttctgtctcaaaggt

SEQ ID NO: 46848 - DNA, 15 bp, Homo sapiens
tctgtctcaaaggta

SEQ ID NO: 46849 - DNA, 15 bp, Homo sapiens
ctgtctcaaaggtaa

SEQ ID NO: 46850 - DNA, 15 bp, Homo sapiens
tgtctcaaaggtaag

SEQ ID NO: 46851 - DNA, 15 bp, Homo sapiens
gtctcaaaggtaagc

SEQ ID NO: 46852 - DNA, 15 bp, Homo sapiens
tctcaaaggtaagct

SEQ ID NO: 46853 - DNA, 15 bp, Homo sapiens
ctcaaaggtaagcta

SEQ ID NO: 46854 - DNA, 15 bp, Homo sapiens
tcaaaggtaagctag

SEQ ID NO: 46855 - DNA, 15 bp, Homo sapiens
caaaggtaagctagt

SEQ ID NO: 46856 - DNA, 15 bp, Homo sapiens
aaaggtaagctagtc

SEQ ID NO: 46857 - DNA, 15 bp, Homo sapiens
aaggtaagctagtcc

SEQ ID NO: 46858 - DNA, 15 bp, Homo sapiens
aggtaagctagtccc

SEQ ID NO: 46859 - DNA, 15 bp, Homo sapiens
ggtaagctagtccct

SEQ ID NO: 46860 - DNA, 15 bp, Homo sapiens
gtaagctagtccctg

SEQ ID NO: 46861 - DNA, 15 bp, Homo sapiens
taagctagtccctgt

SEQ ID NO: 46862 - DNA, 15 bp, Homo sapiens
aagctagtccctgtc

SEQ ID NO: 46863 - DNA, 15 bp, Homo sapiens
agctagtccctgtca

SEQ ID NO: 46864 - DNA, 15 bp, Homo sapiens
gctagtccctgtcag

SEQ ID NO: 46865 - DNA, 15 bp, Homo sapiens
ctagtccctgtcaga

SEQ ID NO: 46866 - DNA, 15 bp, Homo sapiens
tagtccctgtcagag

SEQ ID NO: 46867 - DNA, 15 bp, Homo sapiens
agtccctgtcagaga

SEQ ID NO: 46868 - DNA, 15 bp, Homo sapiens
gtccctgtcagagac

SEQ ID NO: 46869 - DNA, 15 bp, Homo sapiens
tccctgtcagagaca

SEQ ID NO: 46870 - DNA, 15 bp, Homo sapiens
ccctgtcagagacag

SEQ ID NO: 46871 - DNA, 15 bp, Homo sapiens
cctgtcagagacaga

SEQ ID NO: 46872 - DNA, 15 bp, Homo sapiens
ctgtcagagacagaa

SEQ ID NO: 46873 - DNA, 15 bp, Homo sapiens
tgtcagagacagaat

SEQ ID NO: 46874 - DNA, 15 bp, Homo sapiens
gtcagagacagaatg

SEQ ID NO: 46875 - DNA, 15 bp, Homo sapiens
tcagagacagaatgt

SEQ ID NO: 46876 - DNA, 15 bp, Homo sapiens
cagagacagaatgtg

SEQ ID NO: 46877 - DNA, 15 bp, Homo sapiens
agagacagaatgtga

SEQ ID NO: 46878 - DNA, 15 bp, Homo sapiens
gagacagaatgtgaa

SEQ ID NO: 46879 - DNA, 15 bp, Homo sapiens
agacagaatgtgaac

SEQ ID NO: 46880 - DNA, 15 bp, Homo sapiens
gacagaatgtgaact

SEQ ID NO: 46881 - DNA, 15 bp, Homo sapiens
acagaatgtgaactc

SEQ ID NO: 46882 - DNA, 15 bp, Homo sapiens
cagaatgtgaactct

SEQ ID NO: 46883 - DNA, 15 bp, Homo sapiens
agaatgtgaactctt

SEQ ID NO: 46884 - DNA, 15 bp, Homo sapiens
gaatgtgaactcttc

SEQ ID NO: 46885 - DNA, 15 bp, Homo sapiens
aatgtgaactcttca

SEQ ID NO: 46886 - DNA, 15 bp, Homo sapiens
atgtgaactcttcag

SEQ ID NO: 46887 - DNA, 15 bp, Homo sapiens
tgtgaactcttcaga

SEQ ID NO: 46888 - DNA, 15 bp, Homo sapiens
gtgaactcttcagaa

SEQ ID NO: 46889 - DNA, 15 bp, Homo sapiens
tgaactcttcagaat

SEQ ID NO: 46890 - DNA, 15 bp, Homo sapiens
gaactcttcagaatg

SEQ ID NO: 46891 - DNA, 15 bp, Homo sapiens
aactcttcagaatga

SEQ ID NO: 46892 - DNA, 15 bp, Homo sapiens
actcttcagaatgat

SEQ ID NO: 46893 - DNA, 15 bp, Homo sapiens
ctcttcagaatgata

SEQ ID NO: 46894 - DNA, 15 bp, Homo sapiens
tcttcagaatgataa

SEQ ID NO: 46895 - DNA, 15 bp, Homo sapiens
cttcagaatgataag

SEQ ID NO: 46896 - DNA, 15 bp, Homo sapiens
ttcagaatgataagc

SEQ ID NO: 46897 - DNA, 15 bp, Homo sapiens
tcagaatgataagca

SEQ ID NO: 46898 - DNA, 15 bp, Homo sapiens
cagaatgataagcag

SEQ ID NO: 46899 - DNA, 15 bp, Homo sapiens
agaatgataagcagt

SEQ ID NO: 46900 - DNA, 15 bp, Homo sapiens
gaatgataagcagtg

SEQ ID NO: 46901 - DNA, 15 bp, Homo sapiens
aatgataagcagtga

SEQ ID NO: 46902 - DNA, 15 bp, Homo sapiens
atgataagcagtgac

SEQ ID NO: 46903 - DNA, 15 bp, Homo sapiens
tgataagcagtgaca

SEQ ID NO: 46904 - DNA, 15 bp, Homo sapiens
gataagcagtgacat

SEQ ID NO: 46905 - DNA, 15 bp, Homo sapiens
ataagcagtgacatg

SEQ ID NO: 46906 - DNA, 15 bp, Homo sapiens
taagcagtgacatgg

SEQ ID NO: 46907 - DNA, 15 bp, Homo sapiens
aagcagtgacatgga

SEQ ID NO: 46908 - DNA, 15 bp, Homo sapiens
agcagtgacatggaa

SEQ ID NO: 46909 - DNA, 15 bp, Homo sapiens
gcagtgacatggaat

SEQ ID NO: 46910 - DNA, 15 bp, Homo sapiens
cagtgacatggaatt

SEQ ID NO: 46911 - DNA, 15 bp, Homo sapiens
agtgacatggaatta

SEQ ID NO: 46912 - DNA, 15 bp, Homo sapiens
gtgacatggaattac

SEQ ID NO: 46913 - DNA, 15 bp, Homo sapiens
tgacatggaattaca

SEQ ID NO: 46914 - DNA, 15 bp, Homo sapiens
gacatggaattacat

SEQ ID NO: 46915 - DNA, 15 bp, Homo sapiens
acatggaattacatt

SEQ ID NO: 46916 - DNA, 15 bp, Homo sapiens
catggaattacatta

SEQ ID NO: 46917 - DNA, 15 bp, Homo sapiens
atggaattacattat

SEQ ID NO: 46918 - DNA, 15 bp, Homo sapiens
tggaattacattatt

SEQ ID NO: 46919 - DNA, 15 bp, Homo sapiens
ggaattacattatta

SEQ ID NO: 46920 - DNA, 15 bp, Homo sapiens
gaattacattattat

SEQ ID NO: 46921 - DNA, 15 bp, Homo sapiens
aattacattattatg

SEQ ID NO: 46922 - DNA, 15 bp, Homo sapiens
attacattattatgt

SEQ ID NO: 46923 - DNA, 15 bp, Homo sapiens
ttacattattatgtg

SEQ ID NO: 46924 - DNA, 15 bp, Homo sapiens
tacattattatgtga

SEQ ID NO: 46925 - DNA, 15 bp, Homo sapiens
acattattatgtgaa

SEQ ID NO: 46926 - DNA, 15 bp, Homo sapiens
cattattatgtgaag

SEQ ID NO: 46927 - DNA, 15 bp, Homo sapiens
attattatgtgaagg

SEQ ID NO: 46928 - DNA, 15 bp, Homo sapiens
ttattatgtgaaggc

SEQ ID NO: 46929 - DNA, 15 bp, Homo sapiens
tattatgtgaaggca

SEQ ID NO: 46930 - DNA, 15 bp, Homo sapiens
attatgtgaaggcac

SEQ ID NO: 46931 - DNA, 15 bp, Homo sapiens
ttatgtgaaggcact

SEQ ID NO: 46932 - DNA, 15 bp, Homo sapiens
tatgtgaaggcactc

SEQ ID NO: 46933 - DNA, 15 bp, Homo sapiens
atgtgaaggcactct

SEQ ID NO: 46934 - DNA, 15 bp, Homo sapiens
tgtgaaggcactctt

SEQ ID NO: 46935 - DNA, 15 bp, Homo sapiens
gtgaaggcactcttt

SEQ ID NO: 46936 - DNA, 15 bp, Homo sapiens
tgaaggcactctttg

SEQ ID NO: 46937 - DNA, 15 bp, Homo sapiens
gaaggcactctttga

SEQ ID NO: 46938 - DNA, 15 bp, Homo sapiens
aaggcactctttgaa

SEQ ID NO: 46939 - DNA, 15 bp, Homo sapiens
aggcactctttgaat

SEQ ID NO: 46940 - DNA, 15 bp, Homo sapiens
ggcactctttgaatt

SEQ ID NO: 46941 - DNA, 15 bp, Homo sapiens
gcactctttgaatta

SEQ ID NO: 46942 - DNA, 15 bp, Homo sapiens
cactctttgaattaa

SEQ ID NO: 46943 - DNA, 15 bp, Homo sapiens
actctttgaattaat

SEQ ID NO: 46944 - DNA, 15 bp, Homo sapiens
ctctttgaattaata

SEQ ID NO: 46945 - DNA, 15 bp, Homo sapiens
tctttgaattaatag

SEQ ID NO: 46946 - DNA, 15 bp, Homo sapiens
ctttgaattaatagt

SEQ ID NO: 46947 - DNA, 15 bp, Homo sapiens
tttgaattaatagtg

SEQ ID NO: 46948 - DNA, 15 bp, Homo sapiens
ttgaattaatagtgt

SEQ ID NO: 46949 - DNA, 15 bp, Homo sapiens
tgaattaatagtgtg

SEQ ID NO: 46950 - DNA, 15 bp, Homo sapiens
gaattaatagtgtga

SEQ ID NO: 46951 - DNA, 15 bp, Homo sapiens
aattaatagtgtgat

SEQ ID NO: 46952 - DNA, 15 bp, Homo sapiens
attaatagtgtgatc

SEQ ID NO: 46953 - DNA, 15 bp, Homo sapiens
ttaatagtgtgatca

SEQ ID NO: 46954 - DNA, 15 bp, Homo sapiens
taatagtgtgatcag

SEQ ID NO: 46955 - DNA, 15 bp, Homo sapiens
aatagtgtgatcagt

SEQ ID NO: 46956 - DNA, 15 bp, Homo sapiens
atagtgtgatcagtg

SEQ ID NO: 46957 - DNA, 15 bp, Homo sapiens
tagtgtgatcagtgg

SEQ ID NO: 46958 - DNA, 15 bp, Homo sapiens
agtgtgatcagtggc

SEQ ID NO: 46959 - DNA, 15 bp, Homo sapiens
gtgtgatcagtggct

SEQ ID NO: 46960 - DNA, 15 bp, Homo sapiens
tgtgatcagtggctt

SEQ ID NO: 46961 - DNA, 15 bp, Homo sapiens
gtgatcagtggcttc

SEQ ID NO: 46962 - DNA, 15 bp, Homo sapiens
tgatcagtggcttct

SEQ ID NO: 46963 - DNA, 15 bp, Homo sapiens
gatcagtggcttctt

SEQ ID NO: 46964 - DNA, 15 bp, Homo sapiens
atcagtggcttctta

SEQ ID NO: 46965 - DNA, 15 bp, Homo sapiens
tcagtggcttcttat

SEQ ID NO: 46966 - DNA, 15 bp, Homo sapiens
cagtggcttcttata

SEQ ID NO: 46967 - DNA, 15 bp, Homo sapiens
agtggcttcttatat

SEQ ID NO: 46968 - DNA, 15 bp, Homo sapiens
gtggcttcttatatt

SEQ ID NO: 46969 - DNA, 15 bp, Homo sapiens
tggcttcttatattt

SEQ ID NO: 46970 - DNA, 15 bp, Homo sapiens
ggcttcttatatttg

SEQ ID NO: 46971 - DNA, 15 bp, Homo sapiens
gcttcttatatttgg

SEQ ID NO: 46972 - DNA, 15 bp, Homo sapiens
cttcttatatttggg

SEQ ID NO: 46973 - DNA, 15 bp, Homo sapiens
ttcttatatttgggt

SEQ ID NO: 46974 - DNA, 15 bp, Homo sapiens
tcttatatttgggtg

SEQ ID NO: 46975 - DNA, 15 bp, Homo sapiens
cttatatttgggtga

SEQ ID NO: 46976 - DNA, 15 bp, Homo sapiens
ttatatttgggtgaa

SEQ ID NO: 46977 - DNA, 15 bp, Homo sapiens
tatatttgggtgaaa

SEQ ID NO: 46978 - DNA, 15 bp, Homo sapiens
atatttgggtgaaat

SEQ ID NO: 46979 - DNA, 15 bp, Homo sapiens
tatttgggtgaaata

SEQ ID NO: 46980 - DNA, 15 bp, Homo sapiens
atttgggtgaaataa

SEQ ID NO: 46981 - DNA, 15 bp, Homo sapiens
tttgggtgaaataat

SEQ ID NO: 46982 - DNA, 15 bp, Homo sapiens
ttgggtgaaataata

SEQ ID NO: 46983 - DNA, 15 bp, Homo sapiens
tgggtgaaataataa

SEQ ID NO: 46984 - DNA, 15 bp, Homo sapiens
gggtgaaataataaa

SEQ ID NO: 46985 - DNA, 15 bp, Homo sapiens
ggtgaaataataaat

SEQ ID NO: 46986 - DNA, 15 bp, Homo sapiens
gtgaaataataaata

SEQ ID NO: 46987 - DNA, 15 bp, Homo sapiens
tgaaataataaatac

SEQ ID NO: 46988 - DNA, 15 bp, Homo sapiens
gaaataataaatact

SEQ ID NO: 46989 - DNA, 15 bp, Homo sapiens
aaataataaatactg

SEQ ID NO: 46990 - DNA, 15 bp, Homo sapiens
aataataaatactgt

SEQ ID NO: 46991 - DNA, 15 bp, Homo sapiens
ataataaatactgtg

SEQ ID NO: 46992 - DNA, 15 bp, Homo sapiens
taataaatactgtgt

SEQ ID NO: 46993 - DNA, 15 bp, Homo sapiens
aataaatactgtgtt

SEQ ID NO: 46994 - DNA, 15 bp, Homo sapiens
ataaatactgtgttt

SEQ ID NO: 46995 - DNA, 15 bp, Homo sapiens
taaatactgtgtttg

SEQ ID NO: 46996 - DNA, 15 bp, Homo sapiens
aaatactgtgtttga

SEQ ID NO: 46997 - DNA, 15 bp, Homo sapiens
aatactgtgtttgat

SEQ ID NO: 46998 - DNA, 15 bp, Homo sapiens
atactgtgtttgatg

SEQ ID NO: 46999 - DNA, 15 bp, Homo sapiens
tactgtgtttgatgt

SEQ ID NO: 47000 - DNA, 15 bp, Homo sapiens
actgtgtttgatgtc

SEQ ID NO: 47001 - DNA, 15 bp, Homo sapiens
ctgtgtttgatgtca

SEQ ID NO: 47002 - DNA, 15 bp, Homo sapiens
tgtgtttgatgtcat

SEQ ID NO: 47003 - DNA, 15 bp, Homo sapiens
gtgtttgatgtcatc

SEQ ID NO: 47004 - DNA, 15 bp, Homo sapiens
tgtttgatgtcatct

SEQ ID NO: 47005 - DNA, 15 bp, Homo sapiens
gtttgatgtcatctt

SEQ ID NO: 47006 - DNA, 15 bp, Homo sapiens
tttgatgtcatctta

SEQ ID NO: 47007 - DNA, 15 bp, Homo sapiens
ttgatgtcatcttat

SEQ ID NO: 47008 - DNA, 15 bp, Homo sapiens
tgatgtcatcttata

SEQ ID NO: 47009 - DNA, 15 bp, Homo sapiens
gatgtcatcttatat

SEQ ID NO: 47010 - DNA, 15 bp, Homo sapiens
atgtcatcttatatt

SEQ ID NO: 47011 - DNA, 15 bp, Homo sapiens
tgtcatcttatattt

SEQ ID NO: 47012 - DNA, 15 bp, Homo sapiens
gtcatcttatattta

SEQ ID NO: 47013 - DNA, 15 bp, Homo sapiens
tcatcttatatttaa

SEQ ID NO: 47014 - DNA, 15 bp, Homo sapiens
catcttatatttaag

SEQ ID NO: 47015 - DNA, 15 bp, Homo sapiens
atcttatatttaagg

SEQ ID NO: 47016 - DNA, 15 bp, Homo sapiens
tcttatatttaaggg

SEQ ID NO: 47017 - DNA, 15 bp, Homo sapiens
cttatatttaaggga

SEQ ID NO: 47018 - DNA, 15 bp, Homo sapiens
ttatatttaagggaa

SEQ ID NO: 47019 - DNA, 15 bp, Homo sapiens
tatatttaagggaaa

SEQ ID NO: 47020 - DNA, 15 bp, Homo sapiens
atatttaagggaaat

SEQ ID NO: 47021 - DNA, 15 bp, Homo sapiens
tatttaagggaaatg

SEQ ID NO: 47022 - DNA, 15 bp, Homo sapiens
atttaagggaaatga

SEQ ID NO: 47023 - DNA, 15 bp, Homo sapiens
tttaagggaaatgaa

SEQ ID NO: 47024 - DNA, 15 bp, Homo sapiens
ttaagggaaatgaaa

SEQ ID NO: 47025 - DNA, 15 bp, Homo sapiens
taagggaaatgaaaa

SEQ ID NO: 47026 - DNA, 15 bp, Homo sapiens
aagggaaatgaaaaa

SEQ ID NO: 47027 - DNA, 15 bp, Homo sapiens
agggaaatgaaaaac

SEQ ID NO: 47028 - DNA, 15 bp, Homo sapiens
gggaaatgaaaaacc

SEQ ID NO: 47029 - DNA, 15 bp, Homo sapiens
ggaaatgaaaaacct

SEQ ID NO: 47030 - DNA, 15 bp, Homo sapiens
gaaatgaaaaaccta

SEQ ID NO: 47031 - DNA, 15 bp, Homo sapiens
aaatgaaaaacctac

SEQ ID NO: 47032 - DNA, 15 bp, Homo sapiens
aatgaaaaacctact

SEQ ID NO: 47033 - DNA, 15 bp, Homo sapiens
atgaaaaacctactt

SEQ ID NO: 47034 - DNA, 15 bp, Homo sapiens
tgaaaaacctactta

SEQ ID NO: 47035 - DNA, 15 bp, Homo sapiens
gaaaaacctacttat

SEQ ID NO: 47036 - DNA, 15 bp, Homo sapiens
aaaaacctacttatt

SEQ ID NO: 47037 - DNA, 15 bp, Homo sapiens
aaaacctacttatta

SEQ ID NO: 47038 - DNA, 15 bp, Homo sapiens
aaacctacttattag

SEQ ID NO: 47039 - DNA, 15 bp, Homo sapiens
aacctacttattaga

SEQ ID NO: 47040 - DNA, 15 bp, Homo sapiens
acctacttattagaa

SEQ ID NO: 47041 - DNA, 15 bp, Homo sapiens
cctacttattagaat

SEQ ID NO: 47042 - DNA, 15 bp, Homo sapiens
ctacttattagaata

SEQ ID NO: 47043 - DNA, 15 bp, Homo sapiens
tacttattagaataa

SEQ ID NO: 47044 - DNA, 15 bp, Homo sapiens
acttattagaataag

SEQ ID NO: 47045 - DNA, 15 bp, Homo sapiens
cttattagaataaga

SEQ ID NO: 47046 - DNA, 15 bp, Homo sapiens
ttattagaataagat

SEQ ID NO: 47047 - DNA, 15 bp, Homo sapiens
tattagaataagatc

SEQ ID NO: 47048 - DNA, 15 bp, Homo sapiens
attagaataagatca

SEQ ID NO: 47049 - DNA, 15 bp, Homo sapiens
ttagaataagatcac

SEQ ID NO: 47050 - DNA, 15 bp, Homo sapiens
tagaataagatcaca

SEQ ID NO: 47051 - DNA, 15 bp, Homo sapiens
agaataagatcacat

SEQ ID NO: 47052 - DNA, 15 bp, Homo sapiens
gaataagatcacatg

SEQ ID NO: 47053 - DNA, 15 bp, Homo sapiens
aataagatcacatgc

SEQ ID NO: 47054 - DNA, 15 bp, Homo sapiens
ataagatcacatgca

SEQ ID NO: 47055 - DNA, 15 bp, Homo sapiens
taagatcacatgcac

SEQ ID NO: 47056 - DNA, 15 bp, Homo sapiens
aagatcacatgcaca

SEQ ID NO: 47057 - DNA, 15 bp, Homo sapiens
agatcacatgcacac

SEQ ID NO: 47058 - DNA, 15 bp, Homo sapiens
gatcacatgcacacc

SEQ ID NO: 47059 - DNA, 15 bp, Homo sapiens
atcacatgcacacct

SEQ ID NO: 47060 - DNA, 15 bp, Homo sapiens
tcacatgcacacctg

SEQ ID NO: 47061 - DNA, 15 bp, Homo sapiens
cacatgcacacctgt

SEQ ID NO: 47062 - DNA, 15 bp, Homo sapiens
acatgcacacctgta

SEQ ID NO: 47063 - DNA, 15 bp, Homo sapiens
catgcacacctgtac

SEQ ID NO: 47064 - DNA, 15 bp, Homo sapiens
atgcacacctgtact

SEQ ID NO: 47065 - DNA, 15 bp, Homo sapiens
tgcacacctgtactt

SEQ ID NO: 47066 - DNA, 15 bp, Homo sapiens
gcacacctgtacttt

SEQ ID NO: 47067 - DNA, 15 bp, Homo sapiens
cacacctgtactttg

SEQ ID NO: 47068 - DNA, 15 bp, Homo sapiens
acacctgtactttga

SEQ ID NO: 47069 - DNA, 15 bp, Homo sapiens
cacctgtactttgag

SEQ ID NO: 47070 - DNA, 15 bp, Homo sapiens
acctgtactttgagt

SEQ ID NO: 47071 - DNA, 15 bp, Homo sapiens
cctgtactttgagta

SEQ ID NO: 47072 - DNA, 15 bp, Homo sapiens
ctgtactttgagtat

SEQ ID NO: 47073 - DNA, 15 bp, Homo sapiens
tgtactttgagtatg

SEQ ID NO: 47074 - DNA, 15 bp, Homo sapiens
gtactttgagtatgt

SEQ ID NO: 47075 - DNA, 15 bp, Homo sapiens
tactttgagtatgtt

SEQ ID NO: 47076 - DNA, 15 bp, Homo sapiens
actttgagtatgttt

SEQ ID NO: 47077 - DNA, 15 bp, Homo sapiens
ctttgagtatgtttt

SEQ ID NO: 47078 - DNA, 15 bp, Homo sapiens
tttgagtatgttttt

SEQ ID NO: 47079 - DNA, 15 bp, Homo sapiens
ttgagtatgttttta

SEQ ID NO: 47080 - DNA, 15 bp, Homo sapiens
tgagtatgtttttaa

SEQ ID NO: 47081 - DNA, 15 bp, Homo sapiens
gagtatgtttttaat

SEQ ID NO: 47082 - DNA, 15 bp, Homo sapiens
agtatgtttttaatt

SEQ ID NO: 47083 - DNA, 15 bp, Homo sapiens
gtatgtttttaatta

SEQ ID NO: 47084 - DNA, 15 bp, Homo sapiens
tatgtttttaattat

SEQ ID NO: 47085 - DNA, 15 bp, Homo sapiens
atgtttttaattatc

SEQ ID NO: 47086 - DNA, 15 bp, Homo sapiens
tgtttttaattatct

SEQ ID NO: 47087 - DNA, 15 bp, Homo sapiens
gtttttaattatctg

SEQ ID NO: 47088 - DNA, 15 bp, Homo sapiens
tttttaattatctgg

SEQ ID NO: 47089 - DNA, 15 bp, Homo sapiens
ttttaattatctggg

SEQ ID NO: 47090 - DNA, 15 bp, Homo sapiens
tttaattatctgggt

SEQ ID NO: 47091 - DNA, 15 bp, Homo sapiens
ttaattatctgggtc

SEQ ID NO: 47092 - DNA, 15 bp, Homo sapiens
taattatctgggtca

SEQ ID NO: 47093 - DNA, 15 bp, Homo sapiens
aattatctgggtcac

SEQ ID NO: 47094 - DNA, 15 bp, Homo sapiens
attatctgggtcacc

SEQ ID NO: 47095 - DNA, 15 bp, Homo sapiens
ttatctgggtcacct

SEQ ID NO: 47096 - DNA, 15 bp, Homo sapiens
tatctgggtcacctg

SEQ ID NO: 47097 - DNA, 15 bp, Homo sapiens
atctgggtcacctgt

SEQ ID NO: 47098 - DNA, 15 bp, Homo sapiens
tctgggtcacctgtt

SEQ ID NO: 47099 - DNA, 15 bp, Homo sapiens
ctgggtcacctgttt

SEQ ID NO: 47100 - DNA, 15 bp, Homo sapiens
tgggtcacctgtttc

SEQ ID NO: 47101 - DNA, 15 bp, Homo sapiens
gggtcacctgtttca

SEQ ID NO: 47102 - DNA, 15 bp, Homo sapiens
ggtcacctgtttcag

SEQ ID NO: 47103 - DNA, 15 bp, Homo sapiens
gtcacctgtttcaga

SEQ ID NO: 47104 - DNA, 15 bp, Homo sapiens
tcacctgtttcagag

SEQ ID NO: 47105 - DNA, 15 bp, Homo sapiens
cacctgtttcagagg

SEQ ID NO: 47106 - DNA, 15 bp, Homo sapiens
acctgtttcagagga

SEQ ID NO: 47107 - DNA, 15 bp, Homo sapiens
cctgtttcagaggag

SEQ ID NO: 47108 - DNA, 15 bp, Homo sapiens
ctgtttcagaggagg

SEQ ID NO: 47109 - DNA, 15 bp, Homo sapiens
tgtttcagaggagga

SEQ ID NO: 47110 - DNA, 15 bp, Homo sapiens
gtttcagaggaggat

SEQ ID NO: 47111 - DNA, 15 bp, Homo sapiens
tttcagaggaggata

SEQ ID NO: 47112 - DNA, 15 bp, Homo sapiens
ttcagaggaggataa

SEQ ID NO: 47113 - DNA, 15 bp, Homo sapiens
tcagaggaggataaa

SEQ ID NO: 47114 - DNA, 15 bp, Homo sapiens
cagaggaggataaaa

SEQ ID NO: 47115 - DNA, 15 bp, Homo sapiens
agaggaggataaaaa

SEQ ID NO: 47116 - DNA, 15 bp, Homo sapiens
gaggaggataaaaat

SEQ ID NO: 47117 - DNA, 15 bp, Homo sapiens
aggaggataaaaatg

SEQ ID NO: 47118 - DNA, 15 bp, Homo sapiens
ggaggataaaaatgg

SEQ ID NO: 47119 - DNA, 15 bp, Homo sapiens
gaggataaaaatggc

SEQ ID NO: 47120 - DNA, 15 bp, Homo sapiens
aggataaaaatggcc

SEQ ID NO: 47121 - DNA, 15 bp, Homo sapiens
ggataaaaatggcct

SEQ ID NO: 47122 - DNA, 15 bp, Homo sapiens
gataaaaatggcctt

SEQ ID NO: 47123 - DNA, 15 bp, Homo sapiens
ataaaaatggcctta

SEQ ID NO: 47124 - DNA, 15 bp, Homo sapiens
taaaaatggccttac

SEQ ID NO: 47125 - DNA, 15 bp, Homo sapiens
aaaaatggccttaca

SEQ ID NO: 47126 - DNA, 15 bp, Homo sapiens
aaaatggccttacag

SEQ ID NO: 47127 - DNA, 15 bp, Homo sapiens
aaatggccttacagt

SEQ ID NO: 47128 - DNA, 15 bp, Homo sapiens
aatggccttacagtg

SEQ ID NO: 47129 - DNA, 15 bp, Homo sapiens
atggccttacagtgt

SEQ ID NO: 47130 - DNA, 15 bp, Homo sapiens
tggccttacagtgtt

SEQ ID NO: 47131 - DNA, 15 bp, Homo sapiens
ggccttacagtgttg

SEQ ID NO: 47132 - DNA, 15 bp, Homo sapiens
gccttacagtgttgt

SEQ ID NO: 47133 - DNA, 15 bp, Homo sapiens
ccttacagtgttgta

SEQ ID NO: 47134 - DNA, 15 bp, Homo sapiens
cttacagtgttgtaa

SEQ ID NO: 47135 - DNA, 15 bp, Homo sapiens
ttacagtgttgtaat

SEQ ID NO: 47136 - DNA, 15 bp, Homo sapiens
tacagtgttgtaata

SEQ ID NO: 47137 - DNA, 15 bp, Homo sapiens
acagtgttgtaatag

SEQ ID NO: 47138 - DNA, 15 bp, Homo sapiens
cagtgttgtaataga

SEQ ID NO: 47139 - DNA, 15 bp, Homo sapiens
agtgttgtaatagag

SEQ ID NO: 47140 - DNA, 15 bp, Homo sapiens
gtgttgtaatagagg

SEQ ID NO: 47141 - DNA, 15 bp, Homo sapiens
tgttgtaatagagga

SEQ ID NO: 47142 - DNA, 15 bp, Homo sapiens
gttgtaatagaggac

SEQ ID NO: 47143 - DNA, 15 bp, Homo sapiens
ttgtaatagaggaca

SEQ ID NO: 47144 - DNA, 15 bp, Homo sapiens
tgtaatagaggacag

SEQ ID NO: 47145 - DNA, 15 bp, Homo sapiens
gtaatagaggacaga

SEQ ID NO: 47146 - DNA, 15 bp, Homo sapiens
taatagaggacagat

SEQ ID NO: 47147 - DNA, 15 bp, Homo sapiens
aatagaggacagatt

SEQ ID NO: 47148 - DNA, 15 bp, Homo sapiens
atagaggacagattg

SEQ ID NO: 47149 - DNA, 15 bp, Homo sapiens
tagaggacagattgt

SEQ ID NO: 47150 - DNA, 15 bp, Homo sapiens
agaggacagattgtg

SEQ ID NO: 47151 - DNA, 15 bp, Homo sapiens
gaggacagattgtgc

SEQ ID NO: 47152 - DNA, 15 bp, Homo sapiens
aggacagattgtgct

SEQ ID NO: 47153 - DNA, 15 bp, Homo sapiens
ggacagattgtgctt

SEQ ID NO: 47154 - DNA, 15 bp, Homo sapiens
gacagattgtgcttt

SEQ ID NO: 47155 - DNA, 15 bp, Homo sapiens
acagattgtgctttt

SEQ ID NO: 47156 - DNA, 15 bp, Homo sapiens
cagattgtgcttttg

SEQ ID NO: 47157 - DNA, 15 bp, Homo sapiens
agattgtgcttttgt

SEQ ID NO: 47158 - DNA, 15 bp, Homo sapiens
gattgtgcttttgtg

SEQ ID NO: 47159 - DNA, 15 bp, Homo sapiens
attgtgcttttgtgg

SEQ ID NO: 47160 - DNA, 15 bp, Homo sapiens
ttgtgcttttgtgga

SEQ ID NO: 47161 - DNA, 15 bp, Homo sapiens
tgtgcttttgtggaa

SEQ ID NO: 47162 - DNA, 15 bp, Homo sapiens
gtgcttttgtggaaa

SEQ ID NO: 47163 - DNA, 15 bp, Homo sapiens
tgcttttgtggaaaa

SEQ ID NO: 47164 - DNA, 15 bp, Homo sapiens
gcttttgtggaaaaa

SEQ ID NO: 47165 - DNA, 15 bp, Homo sapiens
cttttgtggaaaaaa

SEQ ID NO: 47166 - DNA, 15 bp, Homo sapiens
ttttgtggaaaaaaa

SEQ ID NO: 47167 - DNA, 15 bp, Homo sapiens
tttgtggaaaaaaaa

SEQ ID NO: 47168 - DNA, 15 bp, Homo sapiens
ttgtggaaaaaaaat

SEQ ID NO: 47169 - DNA, 15 bp, Homo sapiens
tgtggaaaaaaaata

SEQ ID NO: 47170 - DNA, 15 bp, Homo sapiens
gtggaaaaaaaatat

SEQ ID NO: 47171 - DNA, 15 bp, Homo sapiens
tggaaaaaaaatatt

SEQ ID NO: 47172 - DNA, 15 bp, Homo sapiens
ggaaaaaaaatatta

SEQ ID NO: 47173 - DNA, 15 bp, Homo sapiens
gaaaaaaaatattaa

SEQ ID NO: 47174 - DNA, 15 bp, Homo sapiens
aaaaaaaatattaaa

SEQ ID NO: 47175 - DNA, 15 bp, Homo sapiens
aaaaaaatattaaag

SEQ ID NO: 47176 - DNA, 15 bp, Homo sapiens
aaaaaatattaaaga

SEQ ID NO: 47177 - DNA, 15 bp, Homo sapiens
aaaaatattaaagat

SEQ ID NO: 47178 - DNA, 15 bp, Homo sapiens
aaaatattaaagata

SEQ ID NO: 47179 - DNA, 15 bp, Homo sapiens
aaatattaaagataa

SEQ ID NO: 47180 - DNA, 15 bp, Homo sapiens
aatattaaagataaa

SEQ ID NO: 47181 - DNA, 15 bp, Homo sapiens
atattaaagataaat

SEQ ID NO: 47182 - DNA, 15 bp, Homo sapiens
tattaaagataaatt

SEQ ID NO: 47183 - DNA, 15 bp, Homo sapiens
attaaagataaattt

SEQ ID NO: 47184 - DNA, 15 bp, Homo sapiens
ttaaagataaattta

SEQ ID NO: 47185 - DNA, 15 bp, Homo sapiens
taaagataaatttat

SEQ ID NO: 47186 - DNA, 15 bp, Homo sapiens
aaagataaatttatc

SEQ ID NO: 47187 - DNA, 15 bp, Homo sapiens
aagataaatttatct

SEQ ID NO: 47188 - DNA, 15 bp, Homo sapiens
agataaatttatctg

SEQ ID NO: 47189 - DNA, 15 bp, Homo sapiens
gataaatttatctgt

SEQ ID NO: 47190 - DNA, 15 bp, Homo sapiens
ataaatttatctgtg

SEQ ID NO: 47191 - DNA, 15 bp, Homo sapiens
taaatttatctgtgt

SEQ ID NO: 47192 - DNA, 15 bp, Homo sapiens
aaatttatctgtgta

SEQ ID NO: 47193 - DNA, 15 bp, Homo sapiens
aatttatctgtgtac

SEQ ID NO: 47194 - DNA, 15 bp, Homo sapiens
atttatctgtgtact

SEQ ID NO: 47195 - DNA, 15 bp, Homo sapiens
tttatctgtgtactt

SEQ ID NO: 47196 - DNA, 15 bp, Homo sapiens
ttatctgtgtacttc

SEQ ID NO: 47197 - DNA, 15 bp, Homo sapiens
tatctgtgtacttct

SEQ ID NO: 47198 - DNA, 15 bp, Homo sapiens
atctgtgtacttctc

SEQ ID NO: 47199 - DNA, 15 bp, Homo sapiens
tctgtgtacttctcc

SEQ ID NO: 47200 - DNA, 15 bp, Homo sapiens
ctgtgtacttctccc

SEQ ID NO: 47201 - DNA, 15 bp, Homo sapiens
tgtgtacttctccct

SEQ ID NO: 47202 - DNA, 15 bp, Homo sapiens
gtgtacttctccctt

SEQ ID NO: 47203 - DNA, 15 bp, Homo sapiens
tgtacttctcccttt

SEQ ID NO: 47204 - DNA, 15 bp, Homo sapiens
gtacttctccctttt

SEQ ID NO: 47205 - DNA, 15 bp, Homo sapiens
tacttctcccttttt

SEQ ID NO: 47206 - DNA, 15 bp, Homo sapiens
acttctccctttttt

SEQ ID NO: 47207 - DNA, 15 bp, Homo sapiens
cttctcccttttttc

SEQ ID NO: 47208 - DNA, 15 bp, Homo sapiens
ttctcccttttttct

SEQ ID NO: 47209 - DNA, 15 bp, Homo sapiens
tctcccttttttcta

SEQ ID NO: 47210 - DNA, 15 bp, Homo sapiens
ctcccttttttctac

SEQ ID NO: 47211 - DNA, 15 bp, Homo sapiens
tcccttttttctact

SEQ ID NO: 47212 - DNA, 15 bp, Homo sapiens
cccttttttctactt

SEQ ID NO: 47213 - DNA, 15 bp, Homo sapiens
ccttttttctacttt

SEQ ID NO: 47214 - DNA, 15 bp, Homo sapiens
cttttttctactttc

SEQ ID NO: 47215 - DNA, 15 bp, Homo sapiens
ttttttctactttct

SEQ ID NO: 47216 - DNA, 15 bp, Homo sapiens
tttttctactttctg

SEQ ID NO: 47217 - DNA, 15 bp, Homo sapiens
ttttctactttctgt

SEQ ID NO: 47218 - DNA, 15 bp, Homo sapiens
tttctactttctgtg

SEQ ID NO: 47219 - DNA, 15 bp, Homo sapiens
ttctactttctgtgc

SEQ ID NO: 47220 - DNA, 15 bp, Homo sapiens
tctactttctgtgcc

SEQ ID NO: 47221 - DNA, 15 bp, Homo sapiens
ctactttctgtgcct

SEQ ID NO: 47222 - DNA, 15 bp, Homo sapiens
tactttctgtgcctt

SEQ ID NO: 47223 - DNA, 15 bp, Homo sapiens
actttctgtgccttt

SEQ ID NO: 47224 - DNA, 15 bp, Homo sapiens
ctttctgtgccttta

SEQ ID NO: 47225 - DNA, 15 bp, Homo sapiens
tttctgtgcctttaa

SEQ ID NO: 47226 - DNA, 15 bp, Homo sapiens
ttctgtgcctttaac

SEQ ID NO: 47227 - DNA, 15 bp, Homo sapiens
tctgtgcctttaacc

SEQ ID NO: 47228 - DNA, 15 bp, Homo sapiens
ctgtgcctttaacca

SEQ ID NO: 47229 - DNA, 15 bp, Homo sapiens
tgtgcctttaaccaa

SEQ ID NO: 47230 - DNA, 15 bp, Homo sapiens
gtgcctttaaccaat

SEQ ID NO: 47231 - DNA, 15 bp, Homo sapiens
tgcctttaaccaata

SEQ ID NO: 47232 - DNA, 15 bp, Homo sapiens
gcctttaaccaatac

SEQ ID NO: 47233 - DNA, 15 bp, Homo sapiens
cctttaaccaataca

SEQ ID NO: 47234 - DNA, 15 bp, Homo sapiens
ctttaaccaatacag

SEQ ID NO: 47235 - DNA, 15 bp, Homo sapiens
tttaaccaatacagg

SEQ ID NO: 47236 - DNA, 15 bp, Homo sapiens
ttaaccaatacaggc

SEQ ID NO: 47237 - DNA, 15 bp, Homo sapiens
taaccaatacaggca

SEQ ID NO: 47238 - DNA, 15 bp, Homo sapiens
aaccaatacaggcaa

SEQ ID NO: 47239 - DNA, 15 bp, Homo sapiens
accaatacaggcaaa

SEQ ID NO: 47240 - DNA, 15 bp, Homo sapiens
ccaatacaggcaaag

SEQ ID NO: 47241 - DNA, 15 bp, Homo sapiens
caatacaggcaaagg

SEQ ID NO: 47242 - DNA, 15 bp, Homo sapiens
aatacaggcaaaggg

SEQ ID NO: 47243 - DNA, 15 bp, Homo sapiens
atacaggcaaagggt

SEQ ID NO: 47244 - DNA, 15 bp, Homo sapiens
tacaggcaaagggtg

SEQ ID NO: 47245 - DNA, 15 bp, Homo sapiens
acaggcaaagggtgt

SEQ ID NO: 47246 - DNA, 15 bp, Homo sapiens
caggcaaagggtgtg

SEQ ID NO: 47247 - DNA, 15 bp, Homo sapiens
aggcaaagggtgtgt

SEQ ID NO: 47248 - DNA, 15 bp, Homo sapiens
ggcaaagggtgtgta

SEQ ID NO: 47249 - DNA, 15 bp, Homo sapiens
gcaaagggtgtgtat

SEQ ID NO: 47250 - DNA, 15 bp, Homo sapiens
caaagggtgtgtatg

SEQ ID NO: 47251 - DNA, 15 bp, Homo sapiens
aaagggtgtgtatga

SEQ ID NO: 47252 - DNA, 15 bp, Homo sapiens
aagggtgtgtatgaa

SEQ ID NO: 47253 - DNA, 15 bp, Homo sapiens
agggtgtgtatgaaa

SEQ ID NO: 47254 - DNA, 15 bp, Homo sapiens
gggtgtgtatgaaaa

SEQ ID NO: 47255 - DNA, 15 bp, Homo sapiens
ggtgtgtatgaaaaa

SEQ ID NO: 47256 - DNA, 15 bp, Homo sapiens
gtgtgtatgaaaaag

SEQ ID NO: 47257 - DNA, 15 bp, Homo sapiens
tgtgtatgaaaaagt

SEQ ID NO: 47258 - DNA, 15 bp, Homo sapiens
gtgtatgaaaaagtt

SEQ ID NO: 47259 - DNA, 15 bp, Homo sapiens
tgtatgaaaaagttg

SEQ ID NO: 47260 - DNA, 15 bp, Homo sapiens
gtatgaaaaagttgg

SEQ ID NO: 47261 - DNA, 15 bp, Homo sapiens
tatgaaaaagttgga

SEQ ID NO: 47262 - DNA, 15 bp, Homo sapiens
atgaaaaagttggag

SEQ ID NO: 47263 - DNA, 15 bp, Homo sapiens
tgaaaaagttggaga

SEQ ID NO: 47264 - DNA, 15 bp, Homo sapiens
gaaaaagttggagaa

SEQ ID NO: 47265 - DNA, 15 bp, Homo sapiens
aaaaagttggagaag

SEQ ID NO: 47266 - DNA, 15 bp, Homo sapiens
aaaagttggagaagc

SEQ ID NO: 47267 - DNA, 15 bp, Homo sapiens
aaagttggagaagct

SEQ ID NO: 47268 - DNA, 15 bp, Homo sapiens
aagttggagaagcta

SEQ ID NO: 47269 - DNA, 15 bp, Homo sapiens
agttggagaagctac

SEQ ID NO: 47270 - DNA, 15 bp, Homo sapiens
gttggagaagctaca

SEQ ID NO: 47271 - DNA, 15 bp, Homo sapiens
ttggagaagctacag

SEQ ID NO: 47272 - DNA, 15 bp, Homo sapiens
tggagaagctacaga

SEQ ID NO: 47273 - DNA, 15 bp, Homo sapiens
ggagaagctacagag

SEQ ID NO: 47274 - DNA, 15 bp, Homo sapiens
gagaagctacagaga

SEQ ID NO: 47275 - DNA, 15 bp, Homo sapiens
agaagctacagagac

SEQ ID NO: 47276 - DNA, 15 bp, Homo sapiens
gaagctacagagact

SEQ ID NO: 47277 - DNA, 15 bp, Homo sapiens
aagctacagagactg

SEQ ID NO: 47278 - DNA, 15 bp, Homo sapiens
agctacagagactgc

SEQ ID NO: 47279 - DNA, 15 bp, Homo sapiens
gctacagagactgct

SEQ ID NO: 47280 - DNA, 15 bp, Homo sapiens
ctacagagactgctc

SEQ ID NO: 47281 - DNA, 15 bp, Homo sapiens
tacagagactgctct

SEQ ID NO: 47282 - DNA, 15 bp, Homo sapiens
acagagactgctctc

SEQ ID NO: 47283 - DNA, 15 bp, Homo sapiens
cagagactgctctca

SEQ ID NO: 47284 - DNA, 15 bp, Homo sapiens
agagactgctctcac

SEQ ID NO: 47285 - DNA, 15 bp, Homo sapiens
gagactgctctcact

SEQ ID NO: 47286 - DNA, 15 bp, Homo sapiens
agactgctctcactt

SEQ ID NO: 47287 - DNA, 15 bp, Homo sapiens
gactgctctcacttg

SEQ ID NO: 47288 - DNA, 15 bp, Homo sapiens
actgctctcacttgc

SEQ ID NO: 47289 - DNA, 15 bp, Homo sapiens
ctgctctcacttgcc

SEQ ID NO: 47290 - DNA, 15 bp, Homo sapiens
tgctctcacttgcct

SEQ ID NO: 47291 - DNA, 15 bp, Homo sapiens
gctctcacttgccta

SEQ ID NO: 47292 - DNA, 15 bp, Homo sapiens
ctctcacttgcctag

SEQ ID NO: 47293 - DNA, 15 bp, Homo sapiens
tctcacttgcctagt

SEQ ID NO: 47294 - DNA, 15 bp, Homo sapiens
ctcacttgcctagta

SEQ ID NO: 47295 - DNA, 15 bp, Homo sapiens
tcacttgcctagtag

SEQ ID NO: 47296 - DNA, 15 bp, Homo sapiens
cacttgcctagtaga

SEQ ID NO: 47297 - DNA, 15 bp, Homo sapiens
acttgcctagtagag

SEQ ID NO: 47298 - DNA, 15 bp, Homo sapiens
cttgcctagtagaga

SEQ ID NO: 47299 - DNA, 15 bp, Homo sapiens
ttgcctagtagagaa

SEQ ID NO: 47300 - DNA, 15 bp, Homo sapiens
tgcctagtagagaag

SEQ ID NO: 47301 - DNA, 15 bp, Homo sapiens
gcctagtagagaaga

SEQ ID NO: 47302 - DNA, 15 bp, Homo sapiens
cctagtagagaagat

SEQ ID NO: 47303 - DNA, 15 bp, Homo sapiens
ctagtagagaagatg

SEQ ID NO: 47304 - DNA, 15 bp, Homo sapiens
tagtagagaagatga

SEQ ID NO: 47305 - DNA, 15 bp, Homo sapiens
agtagagaagatgaa

SEQ ID NO: 47306 - DNA, 15 bp, Homo sapiens
gtagagaagatgaat

SEQ ID NO: 47307 - DNA, 15 bp, Homo sapiens
tagagaagatgaatg

SEQ ID NO: 47308 - DNA, 15 bp, Homo sapiens
agagaagatgaatgt

SEQ ID NO: 47309 - DNA, 15 bp, Homo sapiens
gagaagatgaatgta

SEQ ID NO: 47310 - DNA, 15 bp, Homo sapiens
agaagatgaatgtat

SEQ ID NO: 47311 - DNA, 15 bp, Homo sapiens
gaagatgaatgtatt

SEQ ID NO: 47312 - DNA, 15 bp, Homo sapiens
aagatgaatgtattt

SEQ ID NO: 47313 - DNA, 15 bp, Homo sapiens
agatgaatgtatttg

SEQ ID NO: 47314 - DNA, 15 bp, Homo sapiens
gatgaatgtatttga

SEQ ID NO: 47315 - DNA, 15 bp, Homo sapiens
atgaatgtatttgat

SEQ ID NO: 47316 - DNA, 15 bp, Homo sapiens
tgaatgtatttgata

SEQ ID NO: 47317 - DNA, 15 bp, Homo sapiens
gaatgtatttgatac

SEQ ID NO: 47318 - DNA, 15 bp, Homo sapiens
aatgtatttgatacc

SEQ ID NO: 47319 - DNA, 15 bp, Homo sapiens
atgtatttgataccg

SEQ ID NO: 47320 - DNA, 15 bp, Homo sapiens
tgtatttgataccga

SEQ ID NO: 47321 - DNA, 15 bp, Homo sapiens
gtatttgataccgaa

SEQ ID NO: 47322 - DNA, 15 bp, Homo sapiens
tatttgataccgaat

SEQ ID NO: 47323 - DNA, 15 bp, Homo sapiens
atttgataccgaatt

SEQ ID NO: 47324 - DNA, 15 bp, Homo sapiens
tttgataccgaattg

SEQ ID NO: 47325 - DNA, 15 bp, Homo sapiens
ttgataccgaattga

SEQ ID NO: 47326 - DNA, 15 bp, Homo sapiens
tgataccgaattgaa

SEQ ID NO: 47327 - DNA, 15 bp, Homo sapiens
gataccgaattgaag

SEQ ID NO: 47328 - DNA, 15 bp, Homo sapiens
ataccgaattgaagg

SEQ ID NO: 47329 - DNA, 15 bp, Homo sapiens
taccgaattgaaggg

SEQ ID NO: 47330 - DNA, 15 bp, Homo sapiens
accgaattgaagggt

SEQ ID NO: 47331 - DNA, 15 bp, Homo sapiens
ccgaattgaagggtc

SEQ ID NO: 47332 - DNA, 15 bp, Homo sapiens
cgaattgaagggtct

SEQ ID NO: 47333 - DNA, 15 bp, Homo sapiens
gaattgaagggtctt

SEQ ID NO: 47334 - DNA, 15 bp, Homo sapiens
aattgaagggtcttt

SEQ ID NO: 47335 - DNA, 15 bp, Homo sapiens
attgaagggtctttc

SEQ ID NO: 47336 - DNA, 15 bp, Homo sapiens
ttgaagggtctttct

SEQ ID NO: 47337 - DNA, 15 bp, Homo sapiens
tgaagggtctttcta

SEQ ID NO: 47338 - DNA, 15 bp, Homo sapiens
gaagggtctttctaa

SEQ ID NO: 47339 - DNA, 15 bp, Homo sapiens
aagggtctttctaaa

SEQ ID NO: 47340 - DNA, 15 bp, Homo sapiens
agggtctttctaaaa

SEQ ID NO: 47341 - DNA, 15 bp, Homo sapiens
gggtctttctaaaat

SEQ ID NO: 47342 - DNA, 15 bp, Homo sapiens
ggtctttctaaaata

SEQ ID NO: 47343 - DNA, 15 bp, Homo sapiens
gtctttctaaaatag

SEQ ID NO: 47344 - DNA, 15 bp, Homo sapiens
tctttctaaaataga

SEQ ID NO: 47345 - DNA, 15 bp, Homo sapiens
ctttctaaaatagaa

SEQ ID NO: 47346 - DNA, 15 bp, Homo sapiens
tttctaaaatagaac

SEQ ID NO: 47347 - DNA, 15 bp, Homo sapiens
ttctaaaatagaacg

SEQ ID NO: 47348 - DNA, 15 bp, Homo sapiens
tctaaaatagaacgt

SEQ ID NO: 47349 - DNA, 15 bp, Homo sapiens
ctaaaatagaacgtg

SEQ ID NO: 47350 - DNA, 15 bp, Homo sapiens
taaaatagaacgtgc

SEQ ID NO: 47351 - DNA, 15 bp, Homo sapiens
aaaatagaacgtgca

SEQ ID NO: 47352 - DNA, 15 bp, Homo sapiens
aaatagaacgtgcaa

SEQ ID NO: 47353 - DNA, 15 bp, Homo sapiens
aatagaacgtgcaaa

SEQ ID NO: 47354 - DNA, 15 bp, Homo sapiens
atagaacgtgcaaat

SEQ ID NO: 47355 - DNA, 15 bp, Homo sapiens
tagaacgtgcaaatg

SEQ ID NO: 47356 - DNA, 15 bp, Homo sapiens
agaacgtgcaaatgc

SEQ ID NO: 47357 - DNA, 15 bp, Homo sapiens
gaacgtgcaaatgcc

SEQ ID NO: 47358 - DNA, 15 bp, Homo sapiens
aacgtgcaaatgcct

SEQ ID NO: 47359 - DNA, 15 bp, Homo sapiens
acgtgcaaatgcctg

SEQ ID NO: 47360 - DNA, 15 bp, Homo sapiens
cgtgcaaatgcctgc

SEQ ID NO: 47361 - DNA, 15 bp, Homo sapiens
gtgcaaatgcctgca

SEQ ID NO: 47362 - DNA, 15 bp, Homo sapiens
tgcaaatgcctgcaa

SEQ ID NO: 47363 - DNA, 15 bp, Homo sapiens
gcaaatgcctgcaac

SEQ ID NO: 47364 - DNA, 15 bp, Homo sapiens
caaatgcctgcaact

SEQ ID NO: 47365 - DNA, 15 bp, Homo sapiens
aaatgcctgcaactc

SEQ ID NO: 47366 - DNA, 15 bp, Homo sapiens
aatgcctgcaactca

SEQ ID NO: 47367 - DNA, 15 bp, Homo sapiens
atgcctgcaactcag

SEQ ID NO: 47368 - DNA, 15 bp, Homo sapiens
tgcctgcaactcagt

SEQ ID NO: 47369 - DNA, 15 bp, Homo sapiens
gcctgcaactcagtg

SEQ ID NO: 47370 - DNA, 15 bp, Homo sapiens
cctgcaactcagtga

SEQ ID NO: 47371 - DNA, 15 bp, Homo sapiens
ctgcaactcagtgag

SEQ ID NO: 47372 - DNA, 15 bp, Homo sapiens
tgcaactcagtgagt

SEQ ID NO: 47373 - DNA, 15 bp, Homo sapiens
gcaactcagtgagta

SEQ ID NO: 47374 - DNA, 15 bp, Homo sapiens
caactcagtgagtat

SEQ ID NO: 47375 - DNA, 15 bp, Homo sapiens
aactcagtgagtatt

SEQ ID NO: 47376 - DNA, 15 bp, Homo sapiens
actcagtgagtattt

SEQ ID NO: 47377 - DNA, 15 bp, Homo sapiens
ctcagtgagtatttg

SEQ ID NO: 47378 - DNA, 15 bp, Homo sapiens
tcagtgagtatttga

SEQ ID NO: 47379 - DNA, 15 bp, Homo sapiens
cagtgagtatttgaa

SEQ ID NO: 47380 - DNA, 15 bp, Homo sapiens
agtgagtatttgaac

SEQ ID NO: 47381 - DNA, 15 bp, Homo sapiens
gtgagtatttgaacc

SEQ ID NO: 47382 - DNA, 15 bp, Homo sapiens
tgagtatttgaacct

SEQ ID NO: 47383 - DNA, 15 bp, Homo sapiens
gagtatttgaacctg

SEQ ID NO: 47384 - DNA, 15 bp, Homo sapiens
agtatttgaacctgg

SEQ ID NO: 47385 - DNA, 15 bp, Homo sapiens
gtatttgaacctggt

SEQ ID NO: 47386 - DNA, 15 bp, Homo sapiens
tatttgaacctggtt

SEQ ID NO: 47387 - DNA, 15 bp, Homo sapiens
atttgaacctggttt

SEQ ID NO: 47388 - DNA, 15 bp, Homo sapiens
tttgaacctggttta

SEQ ID NO: 47389 - DNA, 15 bp, Homo sapiens
ttgaacctggtttat

SEQ ID NO: 47390 - DNA, 15 bp, Homo sapiens
tgaacctggtttatt

SEQ ID NO: 47391 - DNA, 15 bp, Homo sapiens
gaacctggtttattg

SEQ ID NO: 47392 - DNA, 15 bp, Homo sapiens
aacctggtttattgt

SEQ ID NO: 47393 - DNA, 15 bp, Homo sapiens
acctggtttattgtt

SEQ ID NO: 47394 - DNA, 15 bp, Homo sapiens
cctggtttattgttc

SEQ ID NO: 47395 - DNA, 15 bp, Homo sapiens
ctggtttattgttca

SEQ ID NO: 47396 - DNA, 15 bp, Homo sapiens
tggtttattgttcat

SEQ ID NO: 47397 - DNA, 15 bp, Homo sapiens
ggtttattgttcatg

SEQ ID NO: 47398 - DNA, 15 bp, Homo sapiens
gtttattgttcatgc

SEQ ID NO: 47399 - DNA, 15 bp, Homo sapiens
tttattgttcatgct

SEQ ID NO: 47400 - DNA, 15 bp, Homo sapiens
ttattgttcatgctg

SEQ ID NO: 47401 - DNA, 15 bp, Homo sapiens
tattgttcatgctgc

SEQ ID NO: 47402 - DNA, 15 bp, Homo sapiens
attgttcatgctgct

SEQ ID NO: 47403 - DNA, 15 bp, Homo sapiens
ttgttcatgctgctt

SEQ ID NO: 47404 - DNA, 15 bp, Homo sapiens
tgttcatgctgctta

SEQ ID NO: 47405 - DNA, 15 bp, Homo sapiens
gttcatgctgcttat

SEQ ID NO: 47406 - DNA, 15 bp, Homo sapiens
ttcatgctgcttatc

SEQ ID NO: 47407 - DNA, 15 bp, Homo sapiens
tcatgctgcttatca

SEQ ID NO: 47408 - DNA, 15 bp, Homo sapiens
catgctgcttatcag

SEQ ID NO: 47409 - DNA, 15 bp, Homo sapiens
atgctgcttatcagt

SEQ ID NO: 47410 - DNA, 15 bp, Homo sapiens
tgctgcttatcagtc

SEQ ID NO: 47411 - DNA, 15 bp, Homo sapiens
gctgcttatcagtcg

SEQ ID NO: 47412 - DNA, 15 bp, Homo sapiens
ctgcttatcagtcgt

SEQ ID NO: 47413 - DNA, 15 bp, Homo sapiens
tgcttatcagtcgta

SEQ ID NO: 47414 - DNA, 15 bp, Homo sapiens
gcttatcagtcgtac

SEQ ID NO: 47415 - DNA, 15 bp, Homo sapiens
cttatcagtcgtact

SEQ ID NO: 47416 - DNA, 15 bp, Homo sapiens
ttatcagtcgtacta

SEQ ID NO: 47417 - DNA, 15 bp, Homo sapiens
tatcagtcgtactat

SEQ ID NO: 47418 - DNA, 15 bp, Homo sapiens
atcagtcgtactata

SEQ ID NO: 47419 - DNA, 15 bp, Homo sapiens
tcagtcgtactatat

SEQ ID NO: 47420 - DNA, 15 bp, Homo sapiens
cagtcgtactatata

SEQ ID NO: 47421 - DNA, 15 bp, Homo sapiens
agtcgtactatatat

SEQ ID NO: 47422 - DNA, 15 bp, Homo sapiens
gtcgtactatatata

SEQ ID NO: 47423 - DNA, 15 bp, Homo sapiens
tcgtactatatatac

SEQ ID NO: 47424 - DNA, 15 bp, Homo sapiens
cgtactatatatact

SEQ ID NO: 47425 - DNA, 15 bp, Homo sapiens
gtactatatatactt

SEQ ID NO: 47426 - DNA, 15 bp, Homo sapiens
tactatatatactta

SEQ ID NO: 47427 - DNA, 15 bp, Homo sapiens
actatatatacttag

SEQ ID NO: 47428 - DNA, 15 bp, Homo sapiens
ctatatatacttagt

SEQ ID NO: 47429 - DNA, 15 bp, Homo sapiens
tatatatacttagtg

SEQ ID NO: 47430 - DNA, 15 bp, Homo sapiens
atatatacttagtgt

SEQ ID NO: 47431 - DNA, 15 bp, Homo sapiens
tatatacttagtgtc

SEQ ID NO: 47432 - DNA, 15 bp, Homo sapiens
atatacttagtgtct

SEQ ID NO: 47433 - DNA, 15 bp, Homo sapiens
tatacttagtgtctg

SEQ ID NO: 47434 - DNA, 15 bp, Homo sapiens
atacttagtgtctgc

SEQ ID NO: 47435 - DNA, 15 bp, Homo sapiens
tacttagtgtctgca

SEQ ID NO: 47436 - DNA, 15 bp, Homo sapiens
acttagtgtctgcac

SEQ ID NO: 47437 - DNA, 15 bp, Homo sapiens
cttagtgtctgcact

SEQ ID NO: 47438 - DNA, 15 bp, Homo sapiens
ttagtgtctgcactg

SEQ ID NO: 47439 - DNA, 15 bp, Homo sapiens
tagtgtctgcactgt

SEQ ID NO: 47440 - DNA, 15 bp, Homo sapiens
agtgtctgcactgtc

SEQ ID NO: 47441 - DNA, 15 bp, Homo sapiens
gtgtctgcactgtcc

SEQ ID NO: 47442 - DNA, 15 bp, Homo sapiens
tgtctgcactgtcct

SEQ ID NO: 47443 - DNA, 15 bp, Homo sapiens
gtctgcactgtccta

SEQ ID NO: 47444 - DNA, 15 bp, Homo sapiens
tctgcactgtcctac

SEQ ID NO: 47445 - DNA, 15 bp, Homo sapiens
ctgcactgtcctact

SEQ ID NO: 47446 - DNA, 15 bp, Homo sapiens
tgcactgtcctactc

SEQ ID NO: 47447 - DNA, 15 bp, Homo sapiens
gcactgtcctactct

SEQ ID NO: 47448 - DNA, 15 bp, Homo sapiens
cactgtcctactctc

SEQ ID NO: 47449 - DNA, 15 bp, Homo sapiens
actgtcctactctct

SEQ ID NO: 47450 - DNA, 15 bp, Homo sapiens
ctgtcctactctctt

SEQ ID NO: 47451 - DNA, 15 bp, Homo sapiens
tgtcctactctctta

SEQ ID NO: 47452 - DNA, 15 bp, Homo sapiens
gtcctactctcttag

SEQ ID NO: 47453 - DNA, 15 bp, Homo sapiens
tcctactctcttaga

SEQ ID NO: 47454 - DNA, 15 bp, Homo sapiens
cctactctcttagaa

SEQ ID NO: 47455 - DNA, 15 bp, Homo sapiens
ctactctcttagaaa

SEQ ID NO: 47456 - DNA, 15 bp, Homo sapiens
tactctcttagaaaa

SEQ ID NO: 47457 - DNA, 15 bp, Homo sapiens
actctcttagaaaac

SEQ ID NO: 47458 - DNA, 15 bp, Homo sapiens
ctctcttagaaaact

SEQ ID NO: 47459 - DNA, 15 bp, Homo sapiens
tctcttagaaaacta

SEQ ID NO: 47460 - DNA, 15 bp, Homo sapiens
ctcttagaaaactaa

SEQ ID NO: 47461 - DNA, 15 bp, Homo sapiens
tcttagaaaactaat

SEQ ID NO: 47462 - DNA, 15 bp, Homo sapiens
cttagaaaactaatt

SEQ ID NO: 47463 - DNA, 15 bp, Homo sapiens
ttagaaaactaatta

SEQ ID NO: 47464 - DNA, 15 bp, Homo sapiens
tagaaaactaattat

SEQ ID NO: 47465 - DNA, 15 bp, Homo sapiens
agaaaactaattata

SEQ ID NO: 47466 - DNA, 15 bp, Homo sapiens
gaaaactaattatac

SEQ ID NO: 47467 - DNA, 15 bp, Homo sapiens
aaaactaattatacc

SEQ ID NO: 47468 - DNA, 15 bp, Homo sapiens
aaactaattatacct

SEQ ID NO: 47469 - DNA, 15 bp, Homo sapiens
aactaattatacctt

SEQ ID NO: 47470 - DNA, 15 bp, Homo sapiens
actaattatacctta

SEQ ID NO: 47471 - DNA, 15 bp, Homo sapiens
ctaattataccttat

SEQ ID NO: 47472 - DNA, 15 bp, Homo sapiens
taattataccttatc

SEQ ID NO: 47473 - DNA, 15 bp, Homo sapiens
aattataccttatct

SEQ ID NO: 47474 - DNA, 15 bp, Homo sapiens
attataccttatctc

SEQ ID NO: 47475 - DNA, 15 bp, Homo sapiens
ttataccttatctcc

SEQ ID NO: 47476 - DNA, 15 bp, Homo sapiens
tataccttatctcct

SEQ ID NO: 47477 - DNA, 15 bp, Homo sapiens
ataccttatctcctc

SEQ ID NO: 47478 - DNA, 15 bp, Homo sapiens
taccttatctcctca

SEQ ID NO: 47479 - DNA, 15 bp, Homo sapiens
accttatctcctcaa

SEQ ID NO: 47480 - DNA, 15 bp, Homo sapiens
ccttatctcctcaaa

SEQ ID NO: 47481 - DNA, 15 bp, Homo sapiens
cttatctcctcaaac

SEQ ID NO: 47482 - DNA, 15 bp, Homo sapiens
ttatctcctcaaact

SEQ ID NO: 47483 - DNA, 15 bp, Homo sapiens
tatctcctcaaactt

SEQ ID NO: 47484 - DNA, 15 bp, Homo sapiens
atctcctcaaactta

SEQ ID NO: 47485 - DNA, 15 bp, Homo sapiens
tctcctcaaacttac

SEQ ID NO: 47486 - DNA, 15 bp, Homo sapiens
ctcctcaaacttaca

SEQ ID NO: 47487 - DNA, 15 bp, Homo sapiens
tcctcaaacttacag

SEQ ID NO: 47488 - DNA, 15 bp, Homo sapiens
cctcaaacttacagt

SEQ ID NO: 47489 - DNA, 15 bp, Homo sapiens
ctcaaacttacagta

SEQ ID NO: 47490 - DNA, 15 bp, Homo sapiens
tcaaacttacagtat

SEQ ID NO: 47491 - DNA, 15 bp, Homo sapiens
caaacttacagtatt

SEQ ID NO: 47492 - DNA, 15 bp, Homo sapiens
aaacttacagtattt

SEQ ID NO: 47493 - DNA, 15 bp, Homo sapiens
aacttacagtatttc

SEQ ID NO: 47494 - DNA, 15 bp, Homo sapiens
acttacagtatttcc

SEQ ID NO: 47495 - DNA, 15 bp, Homo sapiens
cttacagtatttcct

SEQ ID NO: 47496 - DNA, 15 bp, Homo sapiens
ttacagtatttcctt

SEQ ID NO: 47497 - DNA, 15 bp, Homo sapiens
tacagtatttccttc

SEQ ID NO: 47498 - DNA, 15 bp, Homo sapiens
acagtatttccttcc

SEQ ID NO: 47499 - DNA, 15 bp, Homo sapiens
cagtatttccttccc

SEQ ID NO: 47500 - DNA, 15 bp, Homo sapiens
agtatttccttcccc

SEQ ID NO: 47501 - DNA, 15 bp, Homo sapiens
gtatttccttcccca

SEQ ID NO: 47502 - DNA, 15 bp, Homo sapiens
tatttccttccccat

SEQ ID NO: 47503 - DNA, 15 bp, Homo sapiens
atttccttccccata

SEQ ID NO: 47504 - DNA, 15 bp, Homo sapiens
tttccttccccatat

SEQ ID NO: 47505 - DNA, 15 bp, Homo sapiens
ttccttccccatatt

SEQ ID NO: 47506 - DNA, 15 bp, Homo sapiens
tccttccccatattc

SEQ ID NO: 47507 - DNA, 15 bp, Homo sapiens
ccttccccatattca

SEQ ID NO: 47508 - DNA, 15 bp, Homo sapiens
cttccccatattcac

SEQ ID NO: 47509 - DNA, 15 bp, Homo sapiens
ttccccatattcact

SEQ ID NO: 47510 - DNA, 15 bp, Homo sapiens
tccccatattcactc

SEQ ID NO: 47511 - DNA, 15 bp, Homo sapiens
ccccatattcactct

SEQ ID NO: 47512 - DNA, 15 bp, Homo sapiens
cccatattcactctc

SEQ ID NO: 47513 - DNA, 15 bp, Homo sapiens
ccatattcactctca

SEQ ID NO: 47514 - DNA, 15 bp, Homo sapiens
catattcactctcag

SEQ ID NO: 47515 - DNA, 15 bp, Homo sapiens
atattcactctcagg

SEQ ID NO: 47516 - DNA, 15 bp, Homo sapiens
tattcactctcaggt

SEQ ID NO: 47517 - DNA, 15 bp, Homo sapiens
attcactctcaggta

SEQ ID NO: 47518 - DNA, 15 bp, Homo sapiens
ttcactctcaggtaa

SEQ ID NO: 47519 - DNA, 15 bp, Homo sapiens
tcactctcaggtaag

SEQ ID NO: 47520 - DNA, 15 bp, Homo sapiens
cactctcaggtaaga

SEQ ID NO: 47521 - DNA, 15 bp, Homo sapiens
actctcaggtaagat

SEQ ID NO: 47522 - DNA, 15 bp, Homo sapiens
ctctcaggtaagatg

SEQ ID NO: 47523 - DNA, 15 bp, Homo sapiens
tctcaggtaagatgc

SEQ ID NO: 47524 - DNA, 15 bp, Homo sapiens
ctcaggtaagatgct

SEQ ID NO: 47525 - DNA, 15 bp, Homo sapiens
tcaggtaagatgctc

SEQ ID NO: 47526 - DNA, 15 bp, Homo sapiens
caggtaagatgctct

SEQ ID NO: 47527 - DNA, 15 bp, Homo sapiens
aggtaagatgctctt

SEQ ID NO: 47528 - DNA, 15 bp, Homo sapiens
ggtaagatgctcttc

SEQ ID NO: 47529 - DNA, 15 bp, Homo sapiens
gtaagatgctcttcc

SEQ ID NO: 47530 - DNA, 15 bp, Homo sapiens
taagatgctcttcct

SEQ ID NO: 47531 - DNA, 15 bp, Homo sapiens
aagatgctcttcctg

SEQ ID NO: 47532 - DNA, 15 bp, Homo sapiens
agatgctcttcctgt

SEQ ID NO: 47533 - DNA, 15 bp, Homo sapiens
gatgctcttcctgtg

SEQ ID NO: 47534 - DNA, 15 bp, Homo sapiens
atgctcttcctgtgt

SEQ ID NO: 47535 - DNA, 15 bp, Homo sapiens
tgctcttcctgtgta

SEQ ID NO: 47536 - DNA, 15 bp, Homo sapiens
gctcttcctgtgtat

SEQ ID NO: 47537 - DNA, 15 bp, Homo sapiens
ctcttcctgtgtatt

SEQ ID NO: 47538 - DNA, 15 bp, Homo sapiens
tcttcctgtgtattt

SEQ ID NO: 47539 - DNA, 15 bp, Homo sapiens
cttcctgtgtatttg

SEQ ID NO: 47540 - DNA, 15 bp, Homo sapiens
ttcctgtgtatttga

SEQ ID NO: 47541 - DNA, 15 bp, Homo sapiens
tcctgtgtatttgac

SEQ ID NO: 47542 - DNA, 15 bp, Homo sapiens
cctgtgtatttgacc

SEQ ID NO: 47543 - DNA, 15 bp, Homo sapiens
ctgtgtatttgacca

SEQ ID NO: 47544 - DNA, 15 bp, Homo sapiens
tgtgtatttgaccag

SEQ ID NO: 47545 - DNA, 15 bp, Homo sapiens
gtgtatttgaccagg

SEQ ID NO: 47546 - DNA, 15 bp, Homo sapiens
tgtatttgaccagga

SEQ ID NO: 47547 - DNA, 15 bp, Homo sapiens
gtatttgaccaggaa

SEQ ID NO: 47548 - DNA, 15 bp, Homo sapiens
tatttgaccaggaaa

SEQ ID NO: 47549 - DNA, 15 bp, Homo sapiens
atttgaccaggaaaa

SEQ ID NO: 47550 - DNA, 15 bp, Homo sapiens
tttgaccaggaaaat

SEQ ID NO: 47551 - DNA, 15 bp, Homo sapiens
ttgaccaggaaaata

SEQ ID NO: 47552 - DNA, 15 bp, Homo sapiens
tgaccaggaaaataa

SEQ ID NO: 47553 - DNA, 15 bp, Homo sapiens
gaccaggaaaataaa

SEQ ID NO: 47554 - DNA, 15 bp, Homo sapiens
accaggaaaataaaa

SEQ ID NO: 47555 - DNA, 15 bp, Homo sapiens
ccaggaaaataaaag

SEQ ID NO: 47556 - DNA, 15 bp, Homo sapiens
caggaaaataaaagc

SEQ ID NO: 47557 - DNA, 15 bp, Homo sapiens
aggaaaataaaagca

SEQ ID NO: 47558 - DNA, 15 bp, Homo sapiens
ggaaaataaaagcaa

SEQ ID NO: 47559 - DNA, 15 bp, Homo sapiens
gaaaataaaagcaat

SEQ ID NO: 47560 - DNA, 15 bp, Homo sapiens
aaaataaaagcaatc

SEQ ID NO: 47561 - DNA, 15 bp, Homo sapiens
aaataaaagcaatca

SEQ ID NO: 47562 - DNA, 15 bp, Homo sapiens
aataaaagcaatcaa

SEQ ID NO: 47563 - DNA, 15 bp, Homo sapiens
ataaaagcaatcaat

SEQ ID NO: 47564 - DNA, 15 bp, Homo sapiens
taaaagcaatcaata

SEQ ID NO: 47565 - DNA, 15 bp, Homo sapiens
aaaagcaatcaatag

SEQ ID NO: 47566 - DNA, 15 bp, Homo sapiens
aaagcaatcaatagc

SEQ ID NO: 47567 - DNA, 15 bp, Homo sapiens
aagcaatcaatagct

SEQ ID NO: 47568 - DNA, 15 bp, Homo sapiens
agcaatcaatagcta

SEQ ID NO: 47569 - DNA, 15 bp, Homo sapiens
gcaatcaatagctaa

SEQ ID NO: 47570 - DNA, 15 bp, Homo sapiens
caatcaatagctaat

SEQ ID NO: 47571 - DNA, 15 bp, Homo sapiens
aatcaatagctaatt

SEQ ID NO: 47572 - DNA, 15 bp, Homo sapiens
atcaatagctaattt

SEQ ID NO: 47573 - DNA, 15 bp, Homo sapiens
tcaatagctaatttc

SEQ ID NO: 47574 - DNA, 15 bp, Homo sapiens
caatagctaatttcc

SEQ ID NO: 47575 - DNA, 15 bp, Homo sapiens
aatagctaatttcct

SEQ ID NO: 47576 - DNA, 15 bp, Homo sapiens
atagctaatttcctt

SEQ ID NO: 47577 - DNA, 15 bp, Homo sapiens
tagctaatttccttg

SEQ ID NO: 47578 - DNA, 15 bp, Homo sapiens
agctaatttccttga

SEQ ID NO: 47579 - DNA, 15 bp, Homo sapiens
gctaatttccttgag

SEQ ID NO: 47580 - DNA, 15 bp, Homo sapiens
ctaatttccttgagc

SEQ ID NO: 47581 - DNA, 15 bp, Homo sapiens
taatttccttgagcg

SEQ ID NO: 47582 - DNA, 15 bp, Homo sapiens
aatttccttgagcga

SEQ ID NO: 47583 - DNA, 15 bp, Homo sapiens
atttccttgagcgac

SEQ ID NO: 47584 - DNA, 15 bp, Homo sapiens
tttccttgagcgacc

SEQ ID NO: 47585 - DNA, 15 bp, Homo sapiens
ttccttgagcgaccc

SEQ ID NO: 47586 - DNA, 15 bp, Homo sapiens
tccttgagcgaccct

SEQ ID NO: 47587 - DNA, 15 bp, Homo sapiens
ccttgagcgaccctc

SEQ ID NO: 47588 - DNA, 15 bp, Homo sapiens
cttgagcgaccctct

SEQ ID NO: 47589 - DNA, 15 bp, Homo sapiens
ttgagcgaccctctg

SEQ ID NO: 47590 - DNA, 15 bp, Homo sapiens
tgagcgaccctctgg

SEQ ID NO: 47591 - DNA, 15 bp, Homo sapiens
gagcgaccctctggg

SEQ ID NO: 47592 - DNA, 15 bp, Homo sapiens
agcgaccctctgggc

SEQ ID NO: 47593 - DNA, 15 bp, Homo sapiens
gcgaccctctgggcc

SEQ ID NO: 47594 - DNA, 15 bp, Homo sapiens
cgaccctctgggccc

SEQ ID NO: 47595 - DNA, 15 bp, Homo sapiens
gaccctctgggccca

SEQ ID NO: 47596 - DNA, 15 bp, Homo sapiens
accctctgggcccac

SEQ ID NO: 47597 - DNA, 15 bp, Homo sapiens
ccctctgggcccaca

SEQ ID NO: 47598 - DNA, 15 bp, Homo sapiens
cctctgggcccacag

SEQ ID NO: 47599 - DNA, 15 bp, Homo sapiens
ctctgggcccacagg

SEQ ID NO: 47600 - DNA, 15 bp, Homo sapiens
tctgggcccacaggg

SEQ ID NO: 47601 - DNA, 15 bp, Homo sapiens
ctgggcccacagggg

SEQ ID NO: 47602 - DNA, 15 bp, Homo sapiens
tgggcccacaggggc

SEQ ID NO: 47603 - DNA, 15 bp, Homo sapiens
gggcccacaggggct

SEQ ID NO: 47604 - DNA, 15 bp, Homo sapiens
ggcccacaggggctg

SEQ ID NO: 47605 - DNA, 15 bp, Homo sapiens
gcccacaggggctgc

SEQ ID NO: 47606 - DNA, 15 bp, Homo sapiens
cccacaggggctgcc

SEQ ID NO: 47607 - DNA, 15 bp, Homo sapiens
ccacaggggctgcct

SEQ ID NO: 47608 - DNA, 15 bp, Homo sapiens
cacaggggctgcctt

SEQ ID NO: 47609 - DNA, 15 bp, Homo sapiens
acaggggctgccttc

SEQ ID NO: 47610 - DNA, 15 bp, Homo sapiens
caggggctgccttct

SEQ ID NO: 47611 - DNA, 15 bp, Homo sapiens
aggggctgccttctc

SEQ ID NO: 47612 - DNA, 15 bp, Homo sapiens
ggggctgccttctcc

SEQ ID NO: 47613 - DNA, 15 bp, Homo sapiens
gggctgccttctccc

SEQ ID NO: 47614 - DNA, 15 bp, Homo sapiens
ggctgccttctccca

SEQ ID NO: 47615 - DNA, 15 bp, Homo sapiens
gctgccttctcccat

SEQ ID NO: 47616 - DNA, 15 bp, Homo sapiens
ctgccttctcccata

SEQ ID NO: 47617 - DNA, 15 bp, Homo sapiens
tgccttctcccatag

SEQ ID NO: 47618 - DNA, 15 bp, Homo sapiens
gccttctcccatagt

SEQ ID NO: 47619 - DNA, 15 bp, Homo sapiens
ccttctcccatagtg

SEQ ID NO: 47620 - DNA, 15 bp, Homo sapiens
cttctcccatagtgc

SEQ ID NO: 47621 - DNA, 15 bp, Homo sapiens
ttctcccatagtgct

SEQ ID NO: 47622 - DNA, 15 bp, Homo sapiens
tctcccatagtgctg

SEQ ID NO: 47623 - DNA, 15 bp, Homo sapiens
ctcccatagtgctgt

SEQ ID NO: 47624 - DNA, 15 bp, Homo sapiens
tcccatagtgctgtg

SEQ ID NO: 47625 - DNA, 15 bp, Homo sapiens
cccatagtgctgtga

SEQ ID NO: 47626 - DNA, 15 bp, Homo sapiens
ccatagtgctgtgaa

SEQ ID NO: 47627 - DNA, 15 bp, Homo sapiens
catagtgctgtgaac

SEQ ID NO: 47628 - DNA, 15 bp, Homo sapiens
atagtgctgtgaaca

SEQ ID NO: 47629 - DNA, 15 bp, Homo sapiens
tagtgctgtgaacag

SEQ ID NO: 47630 - DNA, 15 bp, Homo sapiens
agtgctgtgaacagt

SEQ ID NO: 47631 - DNA, 15 bp, Homo sapiens
gtgctgtgaacagtg

SEQ ID NO: 47632 - DNA, 15 bp, Homo sapiens
tgctgtgaacagtgt

SEQ ID NO: 47633 - DNA, 15 bp, Homo sapiens
gctgtgaacagtgtt

SEQ ID NO: 47634 - DNA, 15 bp, Homo sapiens
ctgtgaacagtgttc

SEQ ID NO: 47635 - DNA, 15 bp, Homo sapiens
tgtgaacagtgttct

SEQ ID NO: 47636 - DNA, 15 bp, Homo sapiens
gtgaacagtgttctt

SEQ ID NO: 47637 - DNA, 15 bp, Homo sapiens
tgaacagtgttcttg

SEQ ID NO: 47638 - DNA, 15 bp, Homo sapiens
gaacagtgttcttgc

SEQ ID NO: 47639 - DNA, 15 bp, Homo sapiens
aacagtgttcttgct

SEQ ID NO: 47640 - DNA, 15 bp, Homo sapiens
acagtgttcttgctc

SEQ ID NO: 47641 - DNA, 15 bp, Homo sapiens
cagtgttcttgctcc

SEQ ID NO: 47642 - DNA, 15 bp, Homo sapiens
agtgttcttgctcct

SEQ ID NO: 47643 - DNA, 15 bp, Homo sapiens
gtgttcttgctccta

SEQ ID NO: 47644 - DNA, 15 bp, Homo sapiens
tgttcttgctcctag

SEQ ID NO: 47645 - DNA, 15 bp, Homo sapiens
gttcttgctcctagc

SEQ ID NO: 47646 - DNA, 15 bp, Homo sapiens
ttcttgctcctagca

SEQ ID NO: 47647 - DNA, 15 bp, Homo sapiens
tcttgctcctagcag

SEQ ID NO: 47648 - DNA, 15 bp, Homo sapiens
cttgctcctagcaga

SEQ ID NO: 47649 - DNA, 15 bp, Homo sapiens
ttgctcctagcagaa

SEQ ID NO: 47650 - DNA, 15 bp, Homo sapiens
tgctcctagcagaag

SEQ ID NO: 47651 - DNA, 15 bp, Homo sapiens
gctcctagcagaagc

SEQ ID NO: 47652 - DNA, 15 bp, Homo sapiens
ctcctagcagaagcc

SEQ ID NO: 47653 - DNA, 15 bp, Homo sapiens
tcctagcagaagcca

SEQ ID NO: 47654 - DNA, 15 bp, Homo sapiens
cctagcagaagccac

SEQ ID NO: 47655 - DNA, 15 bp, Homo sapiens
ctagcagaagccacc

SEQ ID NO: 47656 - DNA, 15 bp, Homo sapiens
tagcagaagccacct

SEQ ID NO: 47657 - DNA, 15 bp, Homo sapiens
agcagaagccacctc

SEQ ID NO: 47658 - DNA, 15 bp, Homo sapiens
gcagaagccacctcc

SEQ ID NO: 47659 - DNA, 15 bp, Homo sapiens
cagaagccacctcct

SEQ ID NO: 47660 - DNA, 15 bp, Homo sapiens
agaagccacctcctc

SEQ ID NO: 47661 - DNA, 15 bp, Homo sapiens
gaagccacctcctcc

SEQ ID NO: 47662 - DNA, 15 bp, Homo sapiens
aagccacctcctccc

SEQ ID NO: 47663 - DNA, 15 bp, Homo sapiens
agccacctcctccca

SEQ ID NO: 47664 - DNA, 15 bp, Homo sapiens
gccacctcctcccaa

SEQ ID NO: 47665 - DNA, 15 bp, Homo sapiens
ccacctcctcccaac

SEQ ID NO: 47666 - DNA, 15 bp, Homo sapiens
cacctcctcccaaca

SEQ ID NO: 47667 - DNA, 15 bp, Homo sapiens
acctcctcccaacat

SEQ ID NO: 47668 - DNA, 15 bp, Homo sapiens
cctcctcccaacatc

SEQ ID NO: 47669 - DNA, 15 bp, Homo sapiens
ctcctcccaacatct

SEQ ID NO: 47670 - DNA, 15 bp, Homo sapiens
tcctcccaacatctt

SEQ ID NO: 47671 - DNA, 15 bp, Homo sapiens
cctcccaacatcttt

SEQ ID NO: 47672 - DNA, 15 bp, Homo sapiens
ctcccaacatctttg

SEQ ID NO: 47673 - DNA, 15 bp, Homo sapiens
tcccaacatctttgc

SEQ ID NO: 47674 - DNA, 15 bp, Homo sapiens
cccaacatctttgct

SEQ ID NO: 47675 - DNA, 15 bp, Homo sapiens
ccaacatctttgctg

SEQ ID NO: 47676 - DNA, 15 bp, Homo sapiens
caacatctttgctgc

SEQ ID NO: 47677 - DNA, 15 bp, Homo sapiens
aacatctttgctgca

SEQ ID NO: 47678 - DNA, 15 bp, Homo sapiens
acatctttgctgcat

SEQ ID NO: 47679 - DNA, 15 bp, Homo sapiens
catctttgctgcatt

SEQ ID NO: 47680 - DNA, 15 bp, Homo sapiens
atctttgctgcatta

SEQ ID NO: 47681 - DNA, 15 bp, Homo sapiens
tctttgctgcattat

SEQ ID NO: 47682 - DNA, 15 bp, Homo sapiens
ctttgctgcattatt

SEQ ID NO: 47683 - DNA, 15 bp, Homo sapiens
tttgctgcattattg

SEQ ID NO: 47684 - DNA, 15 bp, Homo sapiens
ttgctgcattattga

SEQ ID NO: 47685 - DNA, 15 bp, Homo sapiens
tgctgcattattgat

SEQ ID NO: 47686 - DNA, 15 bp, Homo sapiens
gctgcattattgatt

SEQ ID NO: 47687 - DNA, 15 bp, Homo sapiens
ctgcattattgattt

SEQ ID NO: 47688 - DNA, 15 bp, Homo sapiens
tgcattattgatttc

SEQ ID NO: 47689 - DNA, 15 bp, Homo sapiens
gcattattgatttcc

SEQ ID NO: 47690 - DNA, 15 bp, Homo sapiens
cattattgatttcca

SEQ ID NO: 47691 - DNA, 15 bp, Homo sapiens
attattgatttccat

SEQ ID NO: 47692 - DNA, 15 bp, Homo sapiens
ttattgatttccatc

SEQ ID NO: 47693 - DNA, 15 bp, Homo sapiens
tattgatttccatct

SEQ ID NO: 47694 - DNA, 15 bp, Homo sapiens
attgatttccatctc

SEQ ID NO: 47695 - DNA, 15 bp, Homo sapiens
ttgatttccatctct

SEQ ID NO: 47696 - DNA, 15 bp, Homo sapiens
tgatttccatctcta

SEQ ID NO: 47697 - DNA, 15 bp, Homo sapiens
gatttccatctctac

SEQ ID NO: 47698 - DNA, 15 bp, Homo sapiens
atttccatctctact

SEQ ID NO: 47699 - DNA, 15 bp, Homo sapiens
tttccatctctacta

SEQ ID NO: 47700 - DNA, 15 bp, Homo sapiens
ttccatctctactag

SEQ ID NO: 47701 - DNA, 15 bp, Homo sapiens
tccatctctactaga

SEQ ID NO: 47702 - DNA, 15 bp, Homo sapiens
ccatctctactagat

SEQ ID NO: 47703 - DNA, 15 bp, Homo sapiens
catctctactagatg

SEQ ID NO: 47704 - DNA, 15 bp, Homo sapiens
atctctactagatgt

SEQ ID NO: 47705 - DNA, 15 bp, Homo sapiens
tctctactagatgtt

SEQ ID NO: 47706 - DNA, 15 bp, Homo sapiens
ctctactagatgttc

SEQ ID NO: 47707 - DNA, 15 bp, Homo sapiens
tctactagatgttct

SEQ ID NO: 47708 - DNA, 15 bp, Homo sapiens
ctactagatgttctt

SEQ ID NO: 47709 - DNA, 15 bp, Homo sapiens
tactagatgttcttc

SEQ ID NO: 47710 - DNA, 15 bp, Homo sapiens
actagatgttcttca

SEQ ID NO: 47711 - DNA, 15 bp, Homo sapiens
ctagatgttcttcag

SEQ ID NO: 47712 - DNA, 15 bp, Homo sapiens
tagatgttcttcagc

SEQ ID NO: 47713 - DNA, 15 bp, Homo sapiens
agatgttcttcagca

SEQ ID NO: 47714 - DNA, 15 bp, Homo sapiens
gatgttcttcagcat

SEQ ID NO: 47715 - DNA, 15 bp, Homo sapiens
atgttcttcagcata

SEQ ID NO: 47716 - DNA, 15 bp, Homo sapiens
tgttcttcagcatag

SEQ ID NO: 47717 - DNA, 15 bp, Homo sapiens
gttcttcagcatagg

SEQ ID NO: 47718 - DNA, 15 bp, Homo sapiens
ttcttcagcataggg

SEQ ID NO: 47719 - DNA, 15 bp, Homo sapiens
tcttcagcatagggg

SEQ ID NO: 47720 - DNA, 15 bp, Homo sapiens
cttcagcataggggg

SEQ ID NO: 47721 - DNA, 15 bp, Homo sapiens
ttcagcataggggga

SEQ ID NO: 47722 - DNA, 15 bp, Homo sapiens
tcagcatagggggaa

SEQ ID NO: 47723 - DNA, 15 bp, Homo sapiens
cagcatagggggaaa

SEQ ID NO: 47724 - DNA, 15 bp, Homo sapiens
agcatagggggaaat

SEQ ID NO: 47725 - DNA, 15 bp, Homo sapiens
gcatagggggaaata

SEQ ID NO: 47726 - DNA, 15 bp, Homo sapiens
catagggggaaataa

SEQ ID NO: 47727 - DNA, 15 bp, Homo sapiens
atagggggaaataat

SEQ ID NO: 47728 - DNA, 15 bp, Homo sapiens
tagggggaaataata

SEQ ID NO: 47729 - DNA, 15 bp, Homo sapiens
agggggaaataatag

SEQ ID NO: 47730 - DNA, 15 bp, Homo sapiens
gggggaaataatagt

SEQ ID NO: 47731 - DNA, 15 bp, Homo sapiens
ggggaaataatagtg

SEQ ID NO: 47732 - DNA, 15 bp, Homo sapiens
gggaaataatagtgt

SEQ ID NO: 47733 - DNA, 15 bp, Homo sapiens
ggaaataatagtgtc

SEQ ID NO: 47734 - DNA, 15 bp, Homo sapiens
gaaataatagtgtct

SEQ ID NO: 47735 - DNA, 15 bp, Homo sapiens
aaataatagtgtctt

SEQ ID NO: 47736 - DNA, 15 bp, Homo sapiens
aataatagtgtcttt

SEQ ID NO: 47737 - DNA, 15 bp, Homo sapiens
ataatagtgtctttc

SEQ ID NO: 47738 - DNA, 15 bp, Homo sapiens
taatagtgtctttct

SEQ ID NO: 47739 - DNA, 15 bp, Homo sapiens
aatagtgtctttcta

SEQ ID NO: 47740 - DNA, 15 bp, Homo sapiens
atagtgtctttctat

SEQ ID NO: 47741 - DNA, 15 bp, Homo sapiens
tagtgtctttctatc

SEQ ID NO: 47742 - DNA, 15 bp, Homo sapiens
agtgtctttctatct

SEQ ID NO: 47743 - DNA, 15 bp, Homo sapiens
gtgtctttctatctt

SEQ ID NO: 47744 - DNA, 15 bp, Homo sapiens
tgtctttctatcttg

SEQ ID NO: 47745 - DNA, 15 bp, Homo sapiens
gtctttctatcttga

SEQ ID NO: 47746 - DNA, 15 bp, Homo sapiens
tctttctatcttgaa

SEQ ID NO: 47747 - DNA, 15 bp, Homo sapiens
ctttctatcttgaaa

SEQ ID NO: 47748 - DNA, 15 bp, Homo sapiens
tttctatcttgaaac

SEQ ID NO: 47749 - DNA, 15 bp, Homo sapiens
ttctatcttgaaact

SEQ ID NO: 47750 - DNA, 15 bp, Homo sapiens
tctatcttgaaactt

SEQ ID NO: 47751 - DNA, 15 bp, Homo sapiens
ctatcttgaaacttt

SEQ ID NO: 47752 - DNA, 15 bp, Homo sapiens
tatcttgaaactttc

SEQ ID NO: 47753 - DNA, 15 bp, Homo sapiens
atcttgaaactttcc

SEQ ID NO: 47754 - DNA, 15 bp, Homo sapiens
tcttgaaactttcct

SEQ ID NO: 47755 - DNA, 15 bp, Homo sapiens
cttgaaactttcctt

SEQ ID NO: 47756 - DNA, 15 bp, Homo sapiens
ttgaaactttccttt

SEQ ID NO: 47757 - DNA, 15 bp, Homo sapiens
tgaaactttcctttg

SEQ ID NO: 47758 - DNA, 15 bp, Homo sapiens
gaaactttcctttga

SEQ ID NO: 47759 - DNA, 15 bp, Homo sapiens
aaactttcctttgac

SEQ ID NO: 47760 - DNA, 15 bp, Homo sapiens
aactttcctttgacc

SEQ ID NO: 47761 - DNA, 15 bp, Homo sapiens
actttcctttgacct

SEQ ID NO: 47762 - DNA, 15 bp, Homo sapiens
ctttcctttgacctt

SEQ ID NO: 47763 - DNA, 15 bp, Homo sapiens
tttcctttgacctta

SEQ ID NO: 47764 - DNA, 15 bp, Homo sapiens
ttcctttgaccttat

SEQ ID NO: 47765 - DNA, 15 bp, Homo sapiens
tcctttgaccttatt

SEQ ID NO: 47766 - DNA, 15 bp, Homo sapiens
cctttgaccttattt

SEQ ID NO: 47767 - DNA, 15 bp, Homo sapiens
ctttgaccttatttc

SEQ ID NO: 47768 - DNA, 15 bp, Homo sapiens
tttgaccttatttcc

SEQ ID NO: 47769 - DNA, 15 bp, Homo sapiens
ttgaccttatttccc

SEQ ID NO: 47770 - DNA, 15 bp, Homo sapiens
tgaccttatttcccc

SEQ ID NO: 47771 - DNA, 15 bp, Homo sapiens
gaccttatttcccct

SEQ ID NO: 47772 - DNA, 15 bp, Homo sapiens
accttatttcccctg

SEQ ID NO: 47773 - DNA, 15 bp, Homo sapiens
ccttatttcccctgt

SEQ ID NO: 47774 - DNA, 15 bp, Homo sapiens
cttatttcccctgtc

SEQ ID NO: 47775 - DNA, 15 bp, Homo sapiens
ttatttcccctgtca

SEQ ID NO: 47776 - DNA, 15 bp, Homo sapiens
tatttcccctgtcag

SEQ ID NO: 47777 - DNA, 15 bp, Homo sapiens
atttcccctgtcagc

SEQ ID NO: 47778 - DNA, 15 bp, Homo sapiens
tttcccctgtcagct

SEQ ID NO: 47779 - DNA, 15 bp, Homo sapiens
ttcccctgtcagcta

SEQ ID NO: 47780 - DNA, 15 bp, Homo sapiens
tcccctgtcagctac

SEQ ID NO: 47781 - DNA, 15 bp, Homo sapiens
cccctgtcagctacc

SEQ ID NO: 47782 - DNA, 15 bp, Homo sapiens
ccctgtcagctacca

SEQ ID NO: 47783 - DNA, 15 bp, Homo sapiens
cctgtcagctaccac

SEQ ID NO: 47784 - DNA, 15 bp, Homo sapiens
ctgtcagctaccaca

SEQ ID NO: 47785 - DNA, 15 bp, Homo sapiens
tgtcagctaccacac

SEQ ID NO: 47786 - DNA, 15 bp, Homo sapiens
gtcagctaccacact

SEQ ID NO: 47787 - DNA, 15 bp, Homo sapiens
tcagctaccacactt

SEQ ID NO: 47788 - DNA, 15 bp, Homo sapiens
cagctaccacacttt

SEQ ID NO: 47789 - DNA, 15 bp, Homo sapiens
agctaccacactttc

SEQ ID NO: 47790 - DNA, 15 bp, Homo sapiens
gctaccacactttct

SEQ ID NO: 47791 - DNA, 15 bp, Homo sapiens
ctaccacactttctt

SEQ ID NO: 47792 - DNA, 15 bp, Homo sapiens
taccacactttcttt

SEQ ID NO: 47793 - DNA, 15 bp, Homo sapiens
accacactttctttt

SEQ ID NO: 47794 - DNA, 15 bp, Homo sapiens
ccacactttcttttc

SEQ ID NO: 47795 - DNA, 15 bp, Homo sapiens
cacactttcttttcc

SEQ ID NO: 47796 - DNA, 15 bp, Homo sapiens
acactttcttttcct

SEQ ID NO: 47797 - DNA, 15 bp, Homo sapiens
cactttcttttcctg

SEQ ID NO: 47798 - DNA, 15 bp, Homo sapiens
actttcttttcctgt

SEQ ID NO: 47799 - DNA, 15 bp, Homo sapiens
ctttcttttcctgtt

SEQ ID NO: 47800 - DNA, 15 bp, Homo sapiens
tttcttttcctgttc

SEQ ID NO: 47801 - DNA, 15 bp, Homo sapiens
ttcttttcctgttca

SEQ ID NO: 47802 - DNA, 15 bp, Homo sapiens
tcttttcctgttcaa

SEQ ID NO: 47803 - DNA, 15 bp, Homo sapiens
cttttcctgttcaat

SEQ ID NO: 47804 - DNA, 15 bp, Homo sapiens
ttttcctgttcaatt

SEQ ID NO: 47805 - DNA, 15 bp, Homo sapiens
tttcctgttcaatta

SEQ ID NO: 47806 - DNA, 15 bp, Homo sapiens
ttcctgttcaattaa

SEQ ID NO: 47807 - DNA, 15 bp, Homo sapiens
tcctgttcaattaaa

SEQ ID NO: 47808 - DNA, 15 bp, Homo sapiens
cctgttcaattaaac

SEQ ID NO: 47809 - DNA, 15 bp, Homo sapiens
ctgttcaattaaacc

SEQ ID NO: 47810 - DNA, 15 bp, Homo sapiens
tgttcaattaaacct

SEQ ID NO: 47811 - DNA, 15 bp, Homo sapiens
gttcaattaaacctt

SEQ ID NO: 47812 - DNA, 15 bp, Homo sapiens
ttcaattaaaccttt

SEQ ID NO: 47813 - DNA, 15 bp, Homo sapiens
tcaattaaacctttt

SEQ ID NO: 47814 - DNA, 15 bp, Homo sapiens
caattaaaccttttt

SEQ ID NO: 47815 - DNA, 15 bp, Homo sapiens
aattaaacctttttt

SEQ ID NO: 47816 - DNA, 15 bp, Homo sapiens
attaaaccttttttt

SEQ ID NO: 47817 - DNA, 15 bp, Homo sapiens
ttaaacctttttttt

SEQ ID NO: 47818 - DNA, 15 bp, Homo sapiens
taaaccttttttttt

SEQ ID NO: 47819 - DNA, 15 bp, Homo sapiens
aaacctttttttttt

SEQ ID NO: 47820 - DNA, 15 bp, Homo sapiens
aaccttttttttttt

SEQ ID NO: 47821 - DNA, 15 bp, Homo sapiens
ttttttttgagacag

SEQ ID NO: 47822 - DNA, 15 bp, Homo sapiens
ttttgagacagagtt

SEQ ID NO: 47823 - DNA, 15 bp, Homo sapiens
tttgagacagagttt

SEQ ID NO: 47824 - DNA, 15 bp, Homo sapiens
ttgagacagagtttc

SEQ ID NO: 47825 - DNA, 15 bp, Homo sapiens
tgagacagagtttct

SEQ ID NO: 47826 - DNA, 15 bp, Homo sapiens
gagacagagtttctc

SEQ ID NO: 47827 - DNA, 15 bp, Homo sapiens
agacagagtttctct

SEQ ID NO: 47828 - DNA, 15 bp, Homo sapiens
gacagagtttctctc

SEQ ID NO: 47829 - DNA, 15 bp, Homo sapiens
acagagtttctctct

SEQ ID NO: 47830 - DNA, 15 bp, Homo sapiens
cagagtttctctctg

SEQ ID NO: 47831 - DNA, 15 bp, Homo sapiens
agagtttctctctgt

SEQ ID NO: 47832 - DNA, 15 bp, Homo sapiens
gagtttctctctgtc

SEQ ID NO: 47833 - DNA, 15 bp, Homo sapiens
agtttctctctgtca

SEQ ID NO: 47834 - DNA, 15 bp, Homo sapiens
gtttctctctgtcac

SEQ ID NO: 47835 - DNA, 15 bp, Homo sapiens
tttctctctgtcacc

SEQ ID NO: 47836 - DNA, 15 bp, Homo sapiens
ttctctctgtcacca

SEQ ID NO: 47837 - DNA, 15 bp, Homo sapiens
tctctctgtcaccag

SEQ ID NO: 47838 - DNA, 15 bp, Homo sapiens
ctctctgtcaccaga

SEQ ID NO: 47839 - DNA, 15 bp, Homo sapiens
tctctgtcaccagat

SEQ ID NO: 47840 - DNA, 15 bp, Homo sapiens
ctctgtcaccagatt

SEQ ID NO: 47841 - DNA, 15 bp, Homo sapiens
ctgtcaccagattgg

SEQ ID NO: 47842 - DNA, 15 bp, Homo sapiens
tgtcaccagattgga

SEQ ID NO: 47843 - DNA, 15 bp, Homo sapiens
gtcaccagattggag

SEQ ID NO: 47844 - DNA, 15 bp, Homo sapiens
tcaccagattggagt

SEQ ID NO: 47845 - DNA, 15 bp, Homo sapiens
caccagattggagtg

SEQ ID NO: 47846 - DNA, 15 bp, Homo sapiens
accagattggagtgc

SEQ ID NO: 47847 - DNA, 15 bp, Homo sapiens
ccagattggagtgcc

SEQ ID NO: 47848 - DNA, 15 bp, Homo sapiens
cagattggagtgcca

SEQ ID NO: 47849 - DNA, 15 bp, Homo sapiens
agattggagtgccat

SEQ ID NO: 47850 - DNA, 15 bp, Homo sapiens
gattggagtgccatg

SEQ ID NO: 47851 - DNA, 15 bp, Homo sapiens
attggagtgccatgg

SEQ ID NO: 47852 - DNA, 15 bp, Homo sapiens
ttggagtgccatggc

SEQ ID NO: 47853 - DNA, 15 bp, Homo sapiens
gagtgccatggcgcg

SEQ ID NO: 47854 - DNA, 15 bp, Homo sapiens
agtgccatggcgcga

SEQ ID NO: 47855 - DNA, 15 bp, Homo sapiens
gtgccatggcgcgat

SEQ ID NO: 47856 - DNA, 15 bp, Homo sapiens
tgccatggcgcgatc

SEQ ID NO: 47857 - DNA, 15 bp, Homo sapiens
gccatggcgcgatct

SEQ ID NO: 47858 - DNA, 15 bp, Homo sapiens
ccatggcgcgatctt

SEQ ID NO: 47859 - DNA, 15 bp, Homo sapiens
catggcgcgatcttg

SEQ ID NO: 47860 - DNA, 15 bp, Homo sapiens
atggcgcgatcttgg

SEQ ID NO: 47861 - DNA, 15 bp, Homo sapiens
tggcgcgatcttggc

SEQ ID NO: 47862 - DNA, 15 bp, Homo sapiens
ggcgcgatcttggct

SEQ ID NO: 47863 - DNA, 15 bp, Homo sapiens
gcgcgatcttggctc

SEQ ID NO: 47864 - DNA, 15 bp, Homo sapiens
cgcgatcttggctca

SEQ ID NO: 47865 - DNA, 15 bp, Homo sapiens
cctccacctcccagg

SEQ ID NO: 47866 - DNA, 15 bp, Homo sapiens
ctccacctcccaggt

SEQ ID NO: 47867 - DNA, 15 bp, Homo sapiens
tccacctcccaggtt

SEQ ID NO: 47868 - DNA, 15 bp, Homo sapiens
ccacctcccaggttc

SEQ ID NO: 47869 - DNA, 15 bp, Homo sapiens
cacctcccaggttca

SEQ ID NO: 47870 - DNA, 15 bp, Homo sapiens
acctcccaggttcaa

SEQ ID NO: 47871 - DNA, 15 bp, Homo sapiens
cgattctcctgcctt

SEQ ID NO: 47872 - DNA, 15 bp, Homo sapiens
gattctcctgcctta

SEQ ID NO: 47873 - DNA, 15 bp, Homo sapiens
attctcctgccttag

SEQ ID NO: 47874 - DNA, 15 bp, Homo sapiens
ttctcctgccttagc

SEQ ID NO: 47875 - DNA, 15 bp, Homo sapiens
tctcctgccttagcc

SEQ ID NO: 47876 - DNA, 15 bp, Homo sapiens
tcctgccttagcctc

SEQ ID NO: 47877 - DNA, 15 bp, Homo sapiens
cctgccttagcctcc

SEQ ID NO: 47878 - DNA, 15 bp, Homo sapiens
ctgccttagcctccc

SEQ ID NO: 47879 - DNA, 15 bp, Homo sapiens
tgccttagcctccct

SEQ ID NO: 47880 - DNA, 15 bp, Homo sapiens
gccttagcctcccta

SEQ ID NO: 47881 - DNA, 15 bp, Homo sapiens
ccttagcctccctag

SEQ ID NO: 47882 - DNA, 15 bp, Homo sapiens
cttagcctccctagt

SEQ ID NO: 47883 - DNA, 15 bp, Homo sapiens
ttagcctccctagta

SEQ ID NO: 47884 - DNA, 15 bp, Homo sapiens
tagcctccctagtag

SEQ ID NO: 47885 - DNA, 15 bp, Homo sapiens
ctccctagtagctgg

SEQ ID NO: 47886 - DNA, 15 bp, Homo sapiens
tccctagtagctggg

SEQ ID NO: 47887 - DNA, 15 bp, Homo sapiens
ccctagtagctggga

SEQ ID NO: 47888 - DNA, 15 bp, Homo sapiens
cctagtagctgggat

SEQ ID NO: 47889 - DNA, 15 bp, Homo sapiens
ctagtagctgggatt

SEQ ID NO: 47890 - DNA, 15 bp, Homo sapiens
tagtagctgggatta

SEQ ID NO: 47891 - DNA, 15 bp, Homo sapiens
gggattacaggcaca

SEQ ID NO: 47892 - DNA, 15 bp, Homo sapiens
ggattacaggcacac

SEQ ID NO: 47893 - DNA, 15 bp, Homo sapiens
gattacaggcacacg

SEQ ID NO: 47894 - DNA, 15 bp, Homo sapiens
attacaggcacacgc

SEQ ID NO: 47895 - DNA, 15 bp, Homo sapiens
ttacaggcacacgcc

SEQ ID NO: 47896 - DNA, 15 bp, Homo sapiens
tacaggcacacgcca

SEQ ID NO: 47897 - DNA, 15 bp, Homo sapiens
acaggcacacgccac

SEQ ID NO: 47898 - DNA, 15 bp, Homo sapiens
caggcacacgccacc

SEQ ID NO: 47899 - DNA, 15 bp, Homo sapiens
aggcacacgccacca

SEQ ID NO: 47900 - DNA, 15 bp, Homo sapiens
ggcacacgccaccac

SEQ ID NO: 47901 - DNA, 15 bp, Homo sapiens
gcacacgccaccacg

SEQ ID NO: 47902 - DNA, 15 bp, Homo sapiens
cacacgccaccacgc

SEQ ID NO: 47903 - DNA, 15 bp, Homo sapiens
acacgccaccacgcc

SEQ ID NO: 47904 - DNA, 15 bp, Homo sapiens
cacgccaccacgcct

SEQ ID NO: 47905 - DNA, 15 bp, Homo sapiens
acgccaccacgcctg

SEQ ID NO: 47906 - DNA, 15 bp, Homo sapiens
cgccaccacgcctgg

SEQ ID NO: 47907 - DNA, 15 bp, Homo sapiens
ttttttgtatttttc

SEQ ID NO: 47908 - DNA, 15 bp, Homo sapiens
ttgtatttttcgtag

SEQ ID NO: 47909 - DNA, 15 bp, Homo sapiens
tgtatttttcgtaga

SEQ ID NO: 47910 - DNA, 15 bp, Homo sapiens
gtatttttcgtagaa

SEQ ID NO: 47911 - DNA, 15 bp, Homo sapiens
tatttttcgtagaaa

SEQ ID NO: 47912 - DNA, 15 bp, Homo sapiens
atttttcgtagaaag

SEQ ID NO: 47913 - DNA, 15 bp, Homo sapiens
tttttcgtagaaagg

SEQ ID NO: 47914 - DNA, 15 bp, Homo sapiens
ttttcgtagaaaggg

SEQ ID NO: 47915 - DNA, 15 bp, Homo sapiens
tttcgtagaaagggg

SEQ ID NO: 47916 - DNA, 15 bp, Homo sapiens
ttcgtagaaaggggt

SEQ ID NO: 47917 - DNA, 15 bp, Homo sapiens
tcgtagaaaggggtt

SEQ ID NO: 47918 - DNA, 15 bp, Homo sapiens
cgtagaaaggggttt

SEQ ID NO: 47919 - DNA, 15 bp, Homo sapiens
gtagaaaggggtttc

SEQ ID NO: 47920 - DNA, 15 bp, Homo sapiens
tagaaaggggtttca

SEQ ID NO: 47921 - DNA, 15 bp, Homo sapiens
agaaaggggtttcac

SEQ ID NO: 47922 - DNA, 15 bp, Homo sapiens
gaaaggggtttcacc

SEQ ID NO: 47923 - DNA, 15 bp, Homo sapiens
aaaggggtttcacca

SEQ ID NO: 47924 - DNA, 15 bp, Homo sapiens
aaggggtttcaccat

SEQ ID NO: 47925 - DNA, 15 bp, Homo sapiens
aggggtttcaccatg

SEQ ID NO: 47926 - DNA, 15 bp, Homo sapiens
ggggtttcaccatgc

SEQ ID NO: 47927 - DNA, 15 bp, Homo sapiens
gggtttcaccatgct

SEQ ID NO: 47928 - DNA, 15 bp, Homo sapiens
ggtttcaccatgcta

SEQ ID NO: 47929 - DNA, 15 bp, Homo sapiens
gtttcaccatgctag

SEQ ID NO: 47930 - DNA, 15 bp, Homo sapiens
tttcaccatgctagc

SEQ ID NO: 47931 - DNA, 15 bp, Homo sapiens
ttcaccatgctagcc

SEQ ID NO: 47932 - DNA, 15 bp, Homo sapiens
tcaccatgctagcca

SEQ ID NO: 47933 - DNA, 15 bp, Homo sapiens
caccatgctagccag

SEQ ID NO: 47934 - DNA, 15 bp, Homo sapiens
accatgctagccagg

SEQ ID NO: 47935 - DNA, 15 bp, Homo sapiens
ccatgctagccaggc

SEQ ID NO: 47936 - DNA, 15 bp, Homo sapiens
catgctagccaggct

SEQ ID NO: 47937 - DNA, 15 bp, Homo sapiens
atgctagccaggctg

SEQ ID NO: 47938 - DNA, 15 bp, Homo sapiens
tgctagccaggctgg

SEQ ID NO: 47939 - DNA, 15 bp, Homo sapiens
gctagccaggctggt

SEQ ID NO: 47940 - DNA, 15 bp, Homo sapiens
ctagccaggctggtc

SEQ ID NO: 47941 - DNA, 15 bp, Homo sapiens
caggtgatccgccca

SEQ ID NO: 47942 - DNA, 15 bp, Homo sapiens
aggtgatccgcccac

SEQ ID NO: 47943 - DNA, 15 bp, Homo sapiens
ggtgatccgcccacc

SEQ ID NO: 47944 - DNA, 15 bp, Homo sapiens
gtgatccgcccacct

SEQ ID NO: 47945 - DNA, 15 bp, Homo sapiens
tgatccgcccacctc

SEQ ID NO: 47946 - DNA, 15 bp, Homo sapiens
gatccgcccacctcg

SEQ ID NO: 47947 - DNA, 15 bp, Homo sapiens
atccgcccacctcgg

SEQ ID NO: 47948 - DNA, 15 bp, Homo sapiens
tccgcccacctcggc

SEQ ID NO: 47949 - DNA, 15 bp, Homo sapiens
ccgcccacctcggcc

SEQ ID NO: 47950 - DNA, 15 bp, Homo sapiens
cgcccacctcggcct

SEQ ID NO: 47951 - DNA, 15 bp, Homo sapiens
gcccacctcggcctc

SEQ ID NO: 47952 - DNA, 15 bp, Homo sapiens
tgagccaccgcgcct

SEQ ID NO: 47953 - DNA, 15 bp, Homo sapiens
gagccaccgcgcctg

SEQ ID NO: 47954 - DNA, 15 bp, Homo sapiens
agccaccgcgcctgg

SEQ ID NO: 47955 - DNA, 15 bp, Homo sapiens
gccaccgcgcctggg

SEQ ID NO: 47956 - DNA, 15 bp, Homo sapiens
ccaccgcgcctgggc

SEQ ID NO: 47957 - DNA, 15 bp, Homo sapiens
caccgcgcctgggca

SEQ ID NO: 47958 - DNA, 15 bp, Homo sapiens
accgcgcctgggcat

SEQ ID NO: 47959 - DNA, 15 bp, Homo sapiens
ccgcgcctgggcatc

SEQ ID NO: 47960 - DNA, 15 bp, Homo sapiens
cgcgcctgggcatca

SEQ ID NO: 47961 - DNA, 15 bp, Homo sapiens
gcgcctgggcatcaa

SEQ ID NO: 47962 - DNA, 15 bp, Homo sapiens
cgcctgggcatcaaa

SEQ ID NO: 47963 - DNA, 15 bp, Homo sapiens
gcctgggcatcaaac

SEQ ID NO: 47964 - DNA, 15 bp, Homo sapiens
cctgggcatcaaaca

SEQ ID NO: 47965 - DNA, 15 bp, Homo sapiens
ctgggcatcaaacat

SEQ ID NO: 47966 - DNA, 15 bp, Homo sapiens
tgggcatcaaacatt

SEQ ID NO: 47967 - DNA, 15 bp, Homo sapiens
gggcatcaaacattt

SEQ ID NO: 47968 - DNA, 15 bp, Homo sapiens
ggcatcaaacatttc

SEQ ID NO: 47969 - DNA, 15 bp, Homo sapiens
gcatcaaacatttct

SEQ ID NO: 47970 - DNA, 15 bp, Homo sapiens
catcaaacatttctt

SEQ ID NO: 47971 - DNA, 15 bp, Homo sapiens
atcaaacatttctta

SEQ ID NO: 47972 - DNA, 15 bp, Homo sapiens
tcaaacatttcttaa

SEQ ID NO: 47973 - DNA, 15 bp, Homo sapiens
caaacatttcttaac

SEQ ID NO: 47974 - DNA, 15 bp, Homo sapiens
aaacatttcttaact

SEQ ID NO: 47975 - DNA, 15 bp, Homo sapiens
aacatttcttaactc

SEQ ID NO: 47976 - DNA, 15 bp, Homo sapiens
acatttcttaactca

SEQ ID NO: 47977 - DNA, 15 bp, Homo sapiens
catttcttaactcat

SEQ ID NO: 47978 - DNA, 15 bp, Homo sapiens
atttcttaactcatt

SEQ ID NO: 47979 - DNA, 15 bp, Homo sapiens
tttcttaactcattt

SEQ ID NO: 47980 - DNA, 15 bp, Homo sapiens
ttcttaactcatttg

SEQ ID NO: 47981 - DNA, 15 bp, Homo sapiens
tcttaactcatttga

SEQ ID NO: 47982 - DNA, 15 bp, Homo sapiens
cttaactcatttgat

SEQ ID NO: 47983 - DNA, 15 bp, Homo sapiens
ttaactcatttgatg

SEQ ID NO: 47984 - DNA, 15 bp, Homo sapiens
taactcatttgatga

SEQ ID NO: 47985 - DNA, 15 bp, Homo sapiens
aactcatttgatgag

SEQ ID NO: 47986 - DNA, 15 bp, Homo sapiens
actcatttgatgaga

SEQ ID NO: 47987 - DNA, 15 bp, Homo sapiens
ctcatttgatgagac

SEQ ID NO: 47988 - DNA, 15 bp, Homo sapiens
tcatttgatgagacc

SEQ ID NO: 47989 - DNA, 15 bp, Homo sapiens
catttgatgagacca

SEQ ID NO: 47990 - DNA, 15 bp, Homo sapiens
atttgatgagaccag

SEQ ID NO: 47991 - DNA, 15 bp, Homo sapiens
tttgatgagaccagc

SEQ ID NO: 47992 - DNA, 15 bp, Homo sapiens
ttgatgagaccagca

SEQ ID NO: 47993 - DNA, 15 bp, Homo sapiens
tgatgagaccagcat

SEQ ID NO: 47994 - DNA, 15 bp, Homo sapiens
gatgagaccagcata

SEQ ID NO: 47995 - DNA, 15 bp, Homo sapiens
atgagaccagcataa

SEQ ID NO: 47996 - DNA, 15 bp, Homo sapiens
tgagaccagcataac

SEQ ID NO: 47997 - DNA, 15 bp, Homo sapiens
gagaccagcataacc

SEQ ID NO: 47998 - DNA, 15 bp, Homo sapiens
agaccagcataacca

SEQ ID NO: 47999 - DNA, 15 bp, Homo sapiens
gaccagcataaccaa

SEQ ID NO: 48000 - DNA, 15 bp, Homo sapiens
accagcataaccaaa

SEQ ID NO: 48001 - DNA, 15 bp, Homo sapiens
ccagcataaccaaat

SEQ ID NO: 48002 - DNA, 15 bp, Homo sapiens
cagcataaccaaata

SEQ ID NO: 48003 - DNA, 15 bp, Homo sapiens
agcataaccaaatac

SEQ ID NO: 48004 - DNA, 15 bp, Homo sapiens
gcataaccaaatacc

SEQ ID NO: 48005 - DNA, 15 bp, Homo sapiens
cataaccaaatacca

SEQ ID NO: 48006 - DNA, 15 bp, Homo sapiens
ataaccaaataccaa

SEQ ID NO: 48007 - DNA, 15 bp, Homo sapiens
taaccaaataccaaa

SEQ ID NO: 48008 - DNA, 15 bp, Homo sapiens
aaccaaataccaaag

SEQ ID NO: 48009 - DNA, 15 bp, Homo sapiens
accaaataccaaagg

SEQ ID NO: 48010 - DNA, 15 bp, Homo sapiens
ccaaataccaaaggt

SEQ ID NO: 48011 - DNA, 15 bp, Homo sapiens
caaataccaaaggtc

SEQ ID NO: 48012 - DNA, 15 bp, Homo sapiens
aaataccaaaggtca

SEQ ID NO: 48013 - DNA, 15 bp, Homo sapiens
aataccaaaggtcaa

SEQ ID NO: 48014 - DNA, 15 bp, Homo sapiens
ataccaaaggtcaat

SEQ ID NO: 48015 - DNA, 15 bp, Homo sapiens
taccaaaggtcaatg

SEQ ID NO: 48016 - DNA, 15 bp, Homo sapiens
accaaaggtcaatgt

SEQ ID NO: 48017 - DNA, 15 bp, Homo sapiens
ccaaaggtcaatgtg

SEQ ID NO: 48018 - DNA, 15 bp, Homo sapiens
caaaggtcaatgtgg

SEQ ID NO: 48019 - DNA, 15 bp, Homo sapiens
aaaggtcaatgtggt

SEQ ID NO: 48020 - DNA, 15 bp, Homo sapiens
aaggtcaatgtggtg

SEQ ID NO: 48021 - DNA, 15 bp, Homo sapiens
aggtcaatgtggtga

SEQ ID NO: 48022 - DNA, 15 bp, Homo sapiens
ggtcaatgtggtgat

SEQ ID NO: 48023 - DNA, 15 bp, Homo sapiens
gtcaatgtggtgatg

SEQ ID NO: 48024 - DNA, 15 bp, Homo sapiens
tcaatgtggtgatgg

SEQ ID NO: 48025 - DNA, 15 bp, Homo sapiens
caatgtggtgatggt

SEQ ID NO: 48026 - DNA, 15 bp, Homo sapiens
aatgtggtgatggtg

SEQ ID NO: 48027 - DNA, 15 bp, Homo sapiens
atgtggtgatggtgg

SEQ ID NO: 48028 - DNA, 15 bp, Homo sapiens
tgtggtgatggtggt

SEQ ID NO: 48029 - DNA, 15 bp, Homo sapiens
gtggtgatggtggtg

SEQ ID NO: 48030 - DNA, 15 bp, Homo sapiens
tggtgatggtggtgg

SEQ ID NO: 48031 - DNA, 15 bp, Homo sapiens
ggtgatggtggtggc

SEQ ID NO: 48032 - DNA, 15 bp, Homo sapiens
gtgatggtggtggca

SEQ ID NO: 48033 - DNA, 15 bp, Homo sapiens
tgatggtggtggcag

SEQ ID NO: 48034 - DNA, 15 bp, Homo sapiens
gatggtggtggcagt

SEQ ID NO: 48035 - DNA, 15 bp, Homo sapiens
atggtggtggcagtg

SEQ ID NO: 48036 - DNA, 15 bp, Homo sapiens
tggtggtggcagtgg

SEQ ID NO: 48037 - DNA, 15 bp, Homo sapiens
ggtggtggcagtggc

SEQ ID NO: 48038 - DNA, 15 bp, Homo sapiens
gtggtggcagtggca

SEQ ID NO: 48039 - DNA, 15 bp, Homo sapiens
tggtggcagtggcag

SEQ ID NO: 48040 - DNA, 15 bp, Homo sapiens
ggtggcagtggcagt

SEQ ID NO: 48041 - DNA, 15 bp, Homo sapiens
gtggcagtggcagtg

SEQ ID NO: 48042 - DNA, 15 bp, Homo sapiens
tggcagtggcagtgg

SEQ ID NO: 48043 - DNA, 15 bp, Homo sapiens
ggcagtggcagtggc

SEQ ID NO: 48044 - DNA, 15 bp, Homo sapiens
gcagtggcagtggca

SEQ ID NO: 48045 - DNA, 15 bp, Homo sapiens
cagtggcagtggcag

SEQ ID NO: 48046 - DNA, 15 bp, Homo sapiens
agtggcagtggcagt

SEQ ID NO: 48047 - DNA, 15 bp, Homo sapiens
agtggcagtggcaga

SEQ ID NO: 48048 - DNA, 15 bp, Homo sapiens
gtggcagtggcagag

SEQ ID NO: 48049 - DNA, 15 bp, Homo sapiens
tggcagtggcagagg

SEQ ID NO: 48050 - DNA, 15 bp, Homo sapiens
ggcagtggcagaggg

SEQ ID NO: 48051 - DNA, 15 bp, Homo sapiens
gcagtggcagagggc

SEQ ID NO: 48052 - DNA, 15 bp, Homo sapiens
cagtggcagagggca

SEQ ID NO: 48053 - DNA, 15 bp, Homo sapiens
agtggcagagggcac

SEQ ID NO: 48054 - DNA, 15 bp, Homo sapiens
gtggcagagggcacc

SEQ ID NO: 48055 - DNA, 15 bp, Homo sapiens
tggcagagggcaccc

SEQ ID NO: 48056 - DNA, 15 bp, Homo sapiens
ggcagagggcaccca

SEQ ID NO: 48057 - DNA, 15 bp, Homo sapiens
gcagagggcacccac

SEQ ID NO: 48058 - DNA, 15 bp, Homo sapiens
cagagggcacccaca

SEQ ID NO: 48059 - DNA, 15 bp, Homo sapiens
agagggcacccacat

SEQ ID NO: 48060 - DNA, 15 bp, Homo sapiens
gagggcacccacatt

SEQ ID NO: 48061 - DNA, 15 bp, Homo sapiens
agggcacccacattg

SEQ ID NO: 48062 - DNA, 15 bp, Homo sapiens
gggcacccacattgt

SEQ ID NO: 48063 - DNA, 15 bp, Homo sapiens
ggcacccacattgtt

SEQ ID NO: 48064 - DNA, 15 bp, Homo sapiens
gcacccacattgttc

SEQ ID NO: 48065 - DNA, 15 bp, Homo sapiens
cacccacattgttca

SEQ ID NO: 48066 - DNA, 15 bp, Homo sapiens
acccacattgttcat

SEQ ID NO: 48067 - DNA, 15 bp, Homo sapiens
cccacattgttcatg

SEQ ID NO: 48068 - DNA, 15 bp, Homo sapiens
ccacattgttcatgt

SEQ ID NO: 48069 - DNA, 15 bp, Homo sapiens
cacattgttcatgta

SEQ ID NO: 48070 - DNA, 15 bp, Homo sapiens
acattgttcatgtat

SEQ ID NO: 48071 - DNA, 15 bp, Homo sapiens
cattgttcatgtata

SEQ ID NO: 48072 - DNA, 15 bp, Homo sapiens
attgttcatgtatac

SEQ ID NO: 48073 - DNA, 15 bp, Homo sapiens
ttgttcatgtataca

SEQ ID NO: 48074 - DNA, 15 bp, Homo sapiens
tgttcatgtatacac

SEQ ID NO: 48075 - DNA, 15 bp, Homo sapiens
gttcatgtatacact

SEQ ID NO: 48076 - DNA, 15 bp, Homo sapiens
ttcatgtatacactg

SEQ ID NO: 48077 - DNA, 15 bp, Homo sapiens
tcatgtatacactga

SEQ ID NO: 48078 - DNA, 15 bp, Homo sapiens
catgtatacactgaa

SEQ ID NO: 48079 - DNA, 15 bp, Homo sapiens
atgtatacactgaac

SEQ ID NO: 48080 - DNA, 15 bp, Homo sapiens
tgtatacactgaaca

SEQ ID NO: 48081 - DNA, 15 bp, Homo sapiens
gtatacactgaacaa

SEQ ID NO: 48082 - DNA, 15 bp, Homo sapiens
tatacactgaacaaa

SEQ ID NO: 48083 - DNA, 15 bp, Homo sapiens
atacactgaacaaat

SEQ ID NO: 48084 - DNA, 15 bp, Homo sapiens
tacactgaacaaata

SEQ ID NO: 48085 - DNA, 15 bp, Homo sapiens
acactgaacaaataa

SEQ ID NO: 48086 - DNA, 15 bp, Homo sapiens
cactgaacaaataag

SEQ ID NO: 48087 - DNA, 15 bp, Homo sapiens
actgaacaaataagt

SEQ ID NO: 48088 - DNA, 15 bp, Homo sapiens
ctgaacaaataagtg

SEQ ID NO: 48089 - DNA, 15 bp, Homo sapiens
tgaacaaataagtgg

SEQ ID NO: 48090 - DNA, 15 bp, Homo sapiens
gaacaaataagtggc

SEQ ID NO: 48091 - DNA, 15 bp, Homo sapiens
aacaaataagtggcc

SEQ ID NO: 48092 - DNA, 15 bp, Homo sapiens
acaaataagtggcct

SEQ ID NO: 48093 - DNA, 15 bp, Homo sapiens
caaataagtggcctc

SEQ ID NO: 48094 - DNA, 15 bp, Homo sapiens
aaataagtggcctct

SEQ ID NO: 48095 - DNA, 15 bp, Homo sapiens
aataagtggcctctg

SEQ ID NO: 48096 - DNA, 15 bp, Homo sapiens
ataagtggcctctga

SEQ ID NO: 48097 - DNA, 15 bp, Homo sapiens
taagtggcctctgag

SEQ ID NO: 48098 - DNA, 15 bp, Homo sapiens
aagtggcctctgagc

SEQ ID NO: 48099 - DNA, 15 bp, Homo sapiens
agtggcctctgagcc

SEQ ID NO: 48100 - DNA, 15 bp, Homo sapiens
gtggcctctgagcct

SEQ ID NO: 48101 - DNA, 15 bp, Homo sapiens
tggcctctgagcctt

SEQ ID NO: 48102 - DNA, 15 bp, Homo sapiens
ggcctctgagccttt

SEQ ID NO: 48103 - DNA, 15 bp, Homo sapiens
gcctctgagcctttt

SEQ ID NO: 48104 - DNA, 15 bp, Homo sapiens
cctctgagccttttt

SEQ ID NO: 48105 - DNA, 15 bp, Homo sapiens
ctctgagcctttttc

SEQ ID NO: 48106 - DNA, 15 bp, Homo sapiens
tctgagcctttttct

SEQ ID NO: 48107 - DNA, 15 bp, Homo sapiens
ctgagcctttttctg

SEQ ID NO: 48108 - DNA, 15 bp, Homo sapiens
tgagcctttttctgc

SEQ ID NO: 48109 - DNA, 15 bp, Homo sapiens
gagcctttttctgcc

SEQ ID NO: 48110 - DNA, 15 bp, Homo sapiens
agcctttttctgcct

SEQ ID NO: 48111 - DNA, 15 bp, Homo sapiens
gcctttttctgcctg

SEQ ID NO: 48112 - DNA, 15 bp, Homo sapiens
cctttttctgcctgt

SEQ ID NO: 48113 - DNA, 15 bp, Homo sapiens
ctttttctgcctgtc

SEQ ID NO: 48114 - DNA, 15 bp, Homo sapiens
tttttctgcctgtca

SEQ ID NO: 48115 - DNA, 15 bp, Homo sapiens
ttttctgcctgtcag

SEQ ID NO: 48116 - DNA, 15 bp, Homo sapiens
tttctgcctgtcaga

SEQ ID NO: 48117 - DNA, 15 bp, Homo sapiens
ttctgcctgtcagag

SEQ ID NO: 48118 - DNA, 15 bp, Homo sapiens
tctgcctgtcagagt

SEQ ID NO: 48119 - DNA, 15 bp, Homo sapiens
ctgcctgtcagagtc

SEQ ID NO: 48120 - DNA, 15 bp, Homo sapiens
tgcctgtcagagtct

SEQ ID NO: 48121 - DNA, 15 bp, Homo sapiens
gcctgtcagagtctt

SEQ ID NO: 48122 - DNA, 15 bp, Homo sapiens
cctgtcagagtcttt

SEQ ID NO: 48123 - DNA, 15 bp, Homo sapiens
ctgtcagagtctttg

SEQ ID NO: 48124 - DNA, 15 bp, Homo sapiens
tgtcagagtctttga

SEQ ID NO: 48125 - DNA, 15 bp, Homo sapiens
gtcagagtctttgag

SEQ ID NO: 48126 - DNA, 15 bp, Homo sapiens
tcagagtctttgaga

SEQ ID NO: 48127 - DNA, 15 bp, Homo sapiens
cagagtctttgagac

SEQ ID NO: 48128 - DNA, 15 bp, Homo sapiens
agagtctttgagaca

SEQ ID NO: 48129 - DNA, 15 bp, Homo sapiens
gagtctttgagacag

SEQ ID NO: 48130 - DNA, 15 bp, Homo sapiens
agtctttgagacagg

SEQ ID NO: 48131 - DNA, 15 bp, Homo sapiens
gtctttgagacaggg

SEQ ID NO: 48132 - DNA, 15 bp, Homo sapiens
tctttgagacagggc

SEQ ID NO: 48133 - DNA, 15 bp, Homo sapiens
ctttgagacagggct

SEQ ID NO: 48134 - DNA, 15 bp, Homo sapiens
tttgagacagggctc

SEQ ID NO: 48135 - DNA, 15 bp, Homo sapiens
ttgagacagggctca

SEQ ID NO: 48136 - DNA, 15 bp, Homo sapiens
tgagacagggctcat

SEQ ID NO: 48137 - DNA, 15 bp, Homo sapiens
gagacagggctcatt

SEQ ID NO: 48138 - DNA, 15 bp, Homo sapiens
agacagggctcattc

SEQ ID NO: 48139 - DNA, 15 bp, Homo sapiens
gacagggctcattcg

SEQ ID NO: 48140 - DNA, 15 bp, Homo sapiens
acagggctcattcga

SEQ ID NO: 48141 - DNA, 15 bp, Homo sapiens
cagggctcattcgac

SEQ ID NO: 48142 - DNA, 15 bp, Homo sapiens
agggctcattcgacc

SEQ ID NO: 48143 - DNA, 15 bp, Homo sapiens
gggctcattcgacca

SEQ ID NO: 48144 - DNA, 15 bp, Homo sapiens
ggctcattcgaccag

SEQ ID NO: 48145 - DNA, 15 bp, Homo sapiens
gctcattcgaccagc

SEQ ID NO: 48146 - DNA, 15 bp, Homo sapiens
ctcattcgaccagca

SEQ ID NO: 48147 - DNA, 15 bp, Homo sapiens
tcattcgaccagcat

SEQ ID NO: 48148 - DNA, 15 bp, Homo sapiens
cattcgaccagcatc

SEQ ID NO: 48149 - DNA, 15 bp, Homo sapiens
attcgaccagcatca

SEQ ID NO: 48150 - DNA, 15 bp, Homo sapiens
ttcgaccagcatcac

SEQ ID NO: 48151 - DNA, 15 bp, Homo sapiens
tcgaccagcatcact

SEQ ID NO: 48152 - DNA, 15 bp, Homo sapiens
cgaccagcatcacta

SEQ ID NO: 48153 - DNA, 15 bp, Homo sapiens
gaccagcatcactat

SEQ ID NO: 48154 - DNA, 15 bp, Homo sapiens
accagcatcactatg

SEQ ID NO: 48155 - DNA, 15 bp, Homo sapiens
ccagcatcactatga

SEQ ID NO: 48156 - DNA, 15 bp, Homo sapiens
cagcatcactatgac

SEQ ID NO: 48157 - DNA, 15 bp, Homo sapiens
agcatcactatgaca

SEQ ID NO: 48158 - DNA, 15 bp, Homo sapiens
gcatcactatgacaa

SEQ ID NO: 48159 - DNA, 15 bp, Homo sapiens
catcactatgacaag

SEQ ID NO: 48160 - DNA, 15 bp, Homo sapiens
atcactatgacaagg

SEQ ID NO: 48161 - DNA, 15 bp, Homo sapiens
tcactatgacaaggg

SEQ ID NO: 48162 - DNA, 15 bp, Homo sapiens
cactatgacaagggc

SEQ ID NO: 48163 - DNA, 15 bp, Homo sapiens
actatgacaagggcc

SEQ ID NO: 48164 - DNA, 15 bp, Homo sapiens
ctatgacaagggcca

SEQ ID NO: 48165 - DNA, 15 bp, Homo sapiens
tatgacaagggccag

SEQ ID NO: 48166 - DNA, 15 bp, Homo sapiens
atgacaagggccagt

SEQ ID NO: 48167 - DNA, 15 bp, Homo sapiens
tgacaagggccagta

SEQ ID NO: 48168 - DNA, 15 bp, Homo sapiens
gacaagggccagtag

SEQ ID NO: 48169 - DNA, 15 bp, Homo sapiens
acaagggccagtagc

SEQ ID NO: 48170 - DNA, 15 bp, Homo sapiens
caagggccagtagca

SEQ ID NO: 48171 - DNA, 15 bp, Homo sapiens
aagggccagtagcaa

SEQ ID NO: 48172 - DNA, 15 bp, Homo sapiens
agggccagtagcaag

SEQ ID NO: 48173 - DNA, 15 bp, Homo sapiens
gggccagtagcaagg

SEQ ID NO: 48174 - DNA, 15 bp, Homo sapiens
ggccagtagcaagga

SEQ ID NO: 48175 - DNA, 15 bp, Homo sapiens
gccagtagcaaggat

SEQ ID NO: 48176 - DNA, 15 bp, Homo sapiens
ccagtagcaaggatg

SEQ ID NO: 48177 - DNA, 15 bp, Homo sapiens
cagtagcaaggatgg

SEQ ID NO: 48178 - DNA, 15 bp, Homo sapiens
agtagcaaggatggg

SEQ ID NO: 48179 - DNA, 15 bp, Homo sapiens
gtagcaaggatgggg

SEQ ID NO: 48180 - DNA, 15 bp, Homo sapiens
tagcaaggatgggga

SEQ ID NO: 48181 - DNA, 15 bp, Homo sapiens
agcaaggatggggag

SEQ ID NO: 48182 - DNA, 15 bp, Homo sapiens
gcaaggatggggagt

SEQ ID NO: 48183 - DNA, 15 bp, Homo sapiens
caaggatggggagtc

SEQ ID NO: 48184 - DNA, 15 bp, Homo sapiens
aaggatggggagtct

SEQ ID NO: 48185 - DNA, 15 bp, Homo sapiens
aggatggggagtctc

SEQ ID NO: 48186 - DNA, 15 bp, Homo sapiens
ggatggggagtctcc

SEQ ID NO: 48187 - DNA, 15 bp, Homo sapiens
gatggggagtctcca

SEQ ID NO: 48188 - DNA, 15 bp, Homo sapiens
atggggagtctccac

SEQ ID NO: 48189 - DNA, 15 bp, Homo sapiens
tggggagtctccaca

SEQ ID NO: 48190 - DNA, 15 bp, Homo sapiens
ggggagtctccacag

SEQ ID NO: 48191 - DNA, 15 bp, Homo sapiens
gggagtctccacagt

SEQ ID NO: 48192 - DNA, 15 bp, Homo sapiens
ggagtctccacagtg

SEQ ID NO: 48193 - DNA, 15 bp, Homo sapiens
gagtctccacagtga

SEQ ID NO: 48194 - DNA, 15 bp, Homo sapiens
agtctccacagtgag

SEQ ID NO: 48195 - DNA, 15 bp, Homo sapiens
gtctccacagtgagt

SEQ ID NO: 48196 - DNA, 15 bp, Homo sapiens
tctccacagtgagtt

SEQ ID NO: 48197 - DNA, 15 bp, Homo sapiens
ctccacagtgagttg

SEQ ID NO: 48198 - DNA, 15 bp, Homo sapiens
tccacagtgagttgg

SEQ ID NO: 48199 - DNA, 15 bp, Homo sapiens
ccacagtgagttgga

SEQ ID NO: 48200 - DNA, 15 bp, Homo sapiens
cacagtgagttggac

SEQ ID NO: 48201 - DNA, 15 bp, Homo sapiens
acagtgagttggacc

SEQ ID NO: 48202 - DNA, 15 bp, Homo sapiens
cagtgagttggacct

SEQ ID NO: 48203 - DNA, 15 bp, Homo sapiens
agtgagttggacctg

SEQ ID NO: 48204 - DNA, 15 bp, Homo sapiens
gtgagttggacctga

SEQ ID NO: 48205 - DNA, 15 bp, Homo sapiens
tgagttggacctgag

SEQ ID NO: 48206 - DNA, 15 bp, Homo sapiens
gagttggacctgagt

SEQ ID NO: 48207 - DNA, 15 bp, Homo sapiens
agttggacctgagtg

SEQ ID NO: 48208 - DNA, 15 bp, Homo sapiens
gttggacctgagtga

SEQ ID NO: 48209 - DNA, 15 bp, Homo sapiens
ttggacctgagtgag

SEQ ID NO: 48210 - DNA, 15 bp, Homo sapiens
tggacctgagtgagg

SEQ ID NO: 48211 - DNA, 15 bp, Homo sapiens
ggacctgagtgaggt

SEQ ID NO: 48212 - DNA, 15 bp, Homo sapiens
gacctgagtgaggtt

SEQ ID NO: 48213 - DNA, 15 bp, Homo sapiens
acctgagtgaggttc

SEQ ID NO: 48214 - DNA, 15 bp, Homo sapiens
cctgagtgaggttcc

SEQ ID NO: 48215 - DNA, 15 bp, Homo sapiens
ctgagtgaggttcct

SEQ ID NO: 48216 - DNA, 15 bp, Homo sapiens
tgagtgaggttcctc

SEQ ID NO: 48217 - DNA, 15 bp, Homo sapiens
gagtgaggttcctct

SEQ ID NO: 48218 - DNA, 15 bp, Homo sapiens
agtgaggttcctctc

SEQ ID NO: 48219 - DNA, 15 bp, Homo sapiens
gtgaggttcctctca

SEQ ID NO: 48220 - DNA, 15 bp, Homo sapiens
tgaggttcctctcaa

SEQ ID NO: 48221 - DNA, 15 bp, Homo sapiens
gaggttcctctcaaa

SEQ ID NO: 48222 - DNA, 15 bp, Homo sapiens
aggttcctctcaaag

SEQ ID NO: 48223 - DNA, 15 bp, Homo sapiens
ggttcctctcaaaga

SEQ ID NO: 48224 - DNA, 15 bp, Homo sapiens
gttcctctcaaagag

SEQ ID NO: 48225 - DNA, 15 bp, Homo sapiens
ttcctctcaaagagc

SEQ ID NO: 48226 - DNA, 15 bp, Homo sapiens
tcctctcaaagagct

SEQ ID NO: 48227 - DNA, 15 bp, Homo sapiens
cctctcaaagagctg

SEQ ID NO: 48228 - DNA, 15 bp, Homo sapiens
ctctcaaagagctgc

SEQ ID NO: 48229 - DNA, 15 bp, Homo sapiens
tctcaaagagctgct

SEQ ID NO: 48230 - DNA, 15 bp, Homo sapiens
ctcaaagagctgctg

SEQ ID NO: 48231 - DNA, 15 bp, Homo sapiens
tcaaagagctgctgc

SEQ ID NO: 48232 - DNA, 15 bp, Homo sapiens
caaagagctgctgct

SEQ ID NO: 48233 - DNA, 15 bp, Homo sapiens
aaagagctgctgctc

SEQ ID NO: 48234 - DNA, 15 bp, Homo sapiens
aagagctgctgctcc

SEQ ID NO: 48235 - DNA, 15 bp, Homo sapiens
agagctgctgctccc

SEQ ID NO: 48236 - DNA, 15 bp, Homo sapiens
gagctgctgctccct

SEQ ID NO: 48237 - DNA, 15 bp, Homo sapiens
agctgctgctccctc

SEQ ID NO: 48238 - DNA, 15 bp, Homo sapiens
gctgctgctccctcc

SEQ ID NO: 48239 - DNA, 15 bp, Homo sapiens
ctgctgctccctcct

SEQ ID NO: 48240 - DNA, 15 bp, Homo sapiens
tgctgctccctcctg

SEQ ID NO: 48241 - DNA, 15 bp, Homo sapiens
gctgctccctcctgc

SEQ ID NO: 48242 - DNA, 15 bp, Homo sapiens
ctgctccctcctgcc

SEQ ID NO: 48243 - DNA, 15 bp, Homo sapiens
tgctccctcctgcca

SEQ ID NO: 48244 - DNA, 15 bp, Homo sapiens
gctccctcctgccaa

SEQ ID NO: 48245 - DNA, 15 bp, Homo sapiens
ctccctcctgccaag

SEQ ID NO: 48246 - DNA, 15 bp, Homo sapiens
tccctcctgccaaga

SEQ ID NO: 48247 - DNA, 15 bp, Homo sapiens
ccctcctgccaagac

SEQ ID NO: 48248 - DNA, 15 bp, Homo sapiens
cctcctgccaagacc

SEQ ID NO: 48249 - DNA, 15 bp, Homo sapiens
ctcctgccaagacca

SEQ ID NO: 48250 - DNA, 15 bp, Homo sapiens
tcctgccaagaccac

SEQ ID NO: 48251 - DNA, 15 bp, Homo sapiens
cctgccaagaccacc

SEQ ID NO: 48252 - DNA, 15 bp, Homo sapiens
ctgccaagaccacca

SEQ ID NO: 48253 - DNA, 15 bp, Homo sapiens
tgccaagaccaccat

SEQ ID NO: 48254 - DNA, 15 bp, Homo sapiens
gccaagaccaccata

SEQ ID NO: 48255 - DNA, 15 bp, Homo sapiens
ccaagaccaccatac

SEQ ID NO: 48256 - DNA, 15 bp, Homo sapiens
caagaccaccatact

SEQ ID NO: 48257 - DNA, 15 bp, Homo sapiens
aagaccaccatactg

SEQ ID NO: 48258 - DNA, 15 bp, Homo sapiens
agaccaccatactgg

SEQ ID NO: 48259 - DNA, 15 bp, Homo sapiens
gaccaccatactgga

SEQ ID NO: 48260 - DNA, 15 bp, Homo sapiens
accaccatactggac

SEQ ID NO: 48261 - DNA, 15 bp, Homo sapiens
ccaccatactggacc

SEQ ID NO: 48262 - DNA, 15 bp, Homo sapiens
caccatactggacct

SEQ ID NO: 48263 - DNA, 15 bp, Homo sapiens
accatactggacctg

SEQ ID NO: 48264 - DNA, 15 bp, Homo sapiens
ccatactggacctgt

SEQ ID NO: 48265 - DNA, 15 bp, Homo sapiens
catactggacctgtc

SEQ ID NO: 48266 - DNA, 15 bp, Homo sapiens
atactggacctgtcc

SEQ ID NO: 48267 - DNA, 15 bp, Homo sapiens
tactggacctgtcct

SEQ ID NO: 48268 - DNA, 15 bp, Homo sapiens
actggacctgtcctg

SEQ ID NO: 48269 - DNA, 15 bp, Homo sapiens
ctggacctgtcctgc

SEQ ID NO: 48270 - DNA, 15 bp, Homo sapiens
tggacctgtcctgca

SEQ ID NO: 48271 - DNA, 15 bp, Homo sapiens
ggacctgtcctgcag

SEQ ID NO: 48272 - DNA, 15 bp, Homo sapiens
gacctgtcctgcagt

SEQ ID NO: 48273 - DNA, 15 bp, Homo sapiens
acctgtcctgcagta

SEQ ID NO: 48274 - DNA, 15 bp, Homo sapiens
cctgtcctgcagtac

SEQ ID NO: 48275 - DNA, 15 bp, Homo sapiens
ctgtcctgcagtact

SEQ ID NO: 48276 - DNA, 15 bp, Homo sapiens
tgtcctgcagtactg

SEQ ID NO: 48277 - DNA, 15 bp, Homo sapiens
gtcctgcagtactgc

SEQ ID NO: 48278 - DNA, 15 bp, Homo sapiens
tcctgcagtactgcc

SEQ ID NO: 48279 - DNA, 15 bp, Homo sapiens
cctgcagtactgccc

SEQ ID NO: 48280 - DNA, 15 bp, Homo sapiens
ctgcagtactgccct

SEQ ID NO: 48281 - DNA, 15 bp, Homo sapiens
tgcagtactgccctt

SEQ ID NO: 48282 - DNA, 15 bp, Homo sapiens
gcagtactgccctta

SEQ ID NO: 48283 - DNA, 15 bp, Homo sapiens
cagtactgcccttag

SEQ ID NO: 48284 - DNA, 15 bp, Homo sapiens
agtactgcccttaga

SEQ ID NO: 48285 - DNA, 15 bp, Homo sapiens
gtactgcccttagat

SEQ ID NO: 48286 - DNA, 15 bp, Homo sapiens
tactgcccttagatt

SEQ ID NO: 48287 - DNA, 15 bp, Homo sapiens
actgcccttagattt

SEQ ID NO: 48288 - DNA, 15 bp, Homo sapiens
ctgcccttagatttc

SEQ ID NO: 48289 - DNA, 15 bp, Homo sapiens
tgcccttagatttct

SEQ ID NO: 48290 - DNA, 15 bp, Homo sapiens
gcccttagatttctg

SEQ ID NO: 48291 - DNA, 15 bp, Homo sapiens
cccttagatttctgt

SEQ ID NO: 48292 - DNA, 15 bp, Homo sapiens
ccttagatttctgtg

SEQ ID NO: 48293 - DNA, 15 bp, Homo sapiens
cttagatttctgtgg

SEQ ID NO: 48294 - DNA, 15 bp, Homo sapiens
ttagatttctgtggc

SEQ ID NO: 48295 - DNA, 15 bp, Homo sapiens
tagatttctgtggcc

SEQ ID NO: 48296 - DNA, 15 bp, Homo sapiens
agatttctgtggcct

SEQ ID NO: 48297 - DNA, 15 bp, Homo sapiens
gatttctgtggcctc

SEQ ID NO: 48298 - DNA, 15 bp, Homo sapiens
atttctgtggcctca

SEQ ID NO: 48299 - DNA, 15 bp, Homo sapiens
tttctgtggcctcac

SEQ ID NO: 48300 - DNA, 15 bp, Homo sapiens
ttctgtggcctcaca

SEQ ID NO: 48301 - DNA, 15 bp, Homo sapiens
tctgtggcctcacaa

SEQ ID NO: 48302 - DNA, 15 bp, Homo sapiens
ctgtggcctcacaag

SEQ ID NO: 48303 - DNA, 15 bp, Homo sapiens
tgtggcctcacaagc

SEQ ID NO: 48304 - DNA, 15 bp, Homo sapiens
gtggcctcacaagcc

SEQ ID NO: 48305 - DNA, 15 bp, Homo sapiens
tggcctcacaagccc

SEQ ID NO: 48306 - DNA, 15 bp, Homo sapiens
ggcctcacaagcccg

SEQ ID NO: 48307 - DNA, 15 bp, Homo sapiens
gcctcacaagcccgg

SEQ ID NO: 48308 - DNA, 15 bp, Homo sapiens
cctcacaagcccggg

SEQ ID NO: 48309 - DNA, 15 bp, Homo sapiens
ctcacaagcccgggg

SEQ ID NO: 48310 - DNA, 15 bp, Homo sapiens
tcacaagcccgggga

SEQ ID NO: 48311 - DNA, 15 bp, Homo sapiens
cacaagcccggggag

SEQ ID NO: 48312 - DNA, 15 bp, Homo sapiens
acaagcccggggagc

SEQ ID NO: 48313 - DNA, 15 bp, Homo sapiens
caagcccggggagcc

SEQ ID NO: 48314 - DNA, 15 bp, Homo sapiens
aagcccggggagcct

SEQ ID NO: 48315 - DNA, 15 bp, Homo sapiens
agcccggggagccta

SEQ ID NO: 48316 - DNA, 15 bp, Homo sapiens
gcccggggagcctag

SEQ ID NO: 48317 - DNA, 15 bp, Homo sapiens
cccggggagcctaga

SEQ ID NO: 48318 - DNA, 15 bp, Homo sapiens
ccggggagcctagac

SEQ ID NO: 48319 - DNA, 15 bp, Homo sapiens
cggggagcctagacc

SEQ ID NO: 48320 - DNA, 15 bp, Homo sapiens
ggggagcctagacct

SEQ ID NO: 48321 - DNA, 15 bp, Homo sapiens
gggagcctagacctc

SEQ ID NO: 48322 - DNA, 15 bp, Homo sapiens
ggagcctagacctca

SEQ ID NO: 48323 - DNA, 15 bp, Homo sapiens
gagcctagacctcag

SEQ ID NO: 48324 - DNA, 15 bp, Homo sapiens
agcctagacctcagt

SEQ ID NO: 48325 - DNA, 15 bp, Homo sapiens
gcctagacctcagta

SEQ ID NO: 48326 - DNA, 15 bp, Homo sapiens
cctagacctcagtag

SEQ ID NO: 48327 - DNA, 15 bp, Homo sapiens
ctagacctcagtaga

SEQ ID NO: 48328 - DNA, 15 bp, Homo sapiens
tagacctcagtagaa

SEQ ID NO: 48329 - DNA, 15 bp, Homo sapiens
agacctcagtagaaa

SEQ ID NO: 48330 - DNA, 15 bp, Homo sapiens
gacctcagtagaaac

SEQ ID NO: 48331 - DNA, 15 bp, Homo sapiens
acctcagtagaaaca

SEQ ID NO: 48332 - DNA, 15 bp, Homo sapiens
cctcagtagaaacac

SEQ ID NO: 48333 - DNA, 15 bp, Homo sapiens
ctcagtagaaacact

SEQ ID NO: 48334 - DNA, 15 bp, Homo sapiens
tcagtagaaacactt

SEQ ID NO: 48335 - DNA, 15 bp, Homo sapiens
cagtagaaacacttt

SEQ ID NO: 48336 - DNA, 15 bp, Homo sapiens
agtagaaacactttg

SEQ ID NO: 48337 - DNA, 15 bp, Homo sapiens
gtagaaacactttgc

SEQ ID NO: 48338 - DNA, 15 bp, Homo sapiens
tagaaacactttgca

SEQ ID NO: 48339 - DNA, 15 bp, Homo sapiens
agaaacactttgcaa

SEQ ID NO: 48340 - DNA, 15 bp, Homo sapiens
gaaacactttgcaac

SEQ ID NO: 48341 - DNA, 15 bp, Homo sapiens
aaacactttgcaacg

SEQ ID NO: 48342 - DNA, 15 bp, Homo sapiens
aacactttgcaacgg

SEQ ID NO: 48343 - DNA, 15 bp, Homo sapiens
acactttgcaacggc

SEQ ID NO: 48344 - DNA, 15 bp, Homo sapiens
cactttgcaacggct

SEQ ID NO: 48345 - DNA, 15 bp, Homo sapiens
actttgcaacggctg

SEQ ID NO: 48346 - DNA, 15 bp, Homo sapiens
ctttgcaacggctgc

SEQ ID NO: 48347 - DNA, 15 bp, Homo sapiens
tttgcaacggctgct

SEQ ID NO: 48348 - DNA, 15 bp, Homo sapiens
ttgcaacggctgctg

SEQ ID NO: 48349 - DNA, 15 bp, Homo sapiens
tgcaacggctgctgg

SEQ ID NO: 48350 - DNA, 15 bp, Homo sapiens
gcaacggctgctggt

SEQ ID NO: 48351 - DNA, 15 bp, Homo sapiens
caacggctgctggtg

SEQ ID NO: 48352 - DNA, 15 bp, Homo sapiens
aacggctgctggtga

SEQ ID NO: 48353 - DNA, 15 bp, Homo sapiens
acggctgctggtgaa

SEQ ID NO: 48354 - DNA, 15 bp, Homo sapiens
cggctgctggtgaag

SEQ ID NO: 48355 - DNA, 15 bp, Homo sapiens
ggctgctggtgaaga

SEQ ID NO: 48356 - DNA, 15 bp, Homo sapiens
gctgctggtgaagaa

SEQ ID NO: 48357 - DNA, 15 bp, Homo sapiens
ctgctggtgaagaat

SEQ ID NO: 48358 - DNA, 15 bp, Homo sapiens
tgctggtgaagaatg

SEQ ID NO: 48359 - DNA, 15 bp, Homo sapiens
gctggtgaagaatgg

SEQ ID NO: 48360 - DNA, 15 bp, Homo sapiens
ctggtgaagaatggc

SEQ ID NO: 48361 - DNA, 15 bp, Homo sapiens
tggtgaagaatggcc

SEQ ID NO: 48362 - DNA, 15 bp, Homo sapiens
ggtgaagaatggcca

SEQ ID NO: 48363 - DNA, 15 bp, Homo sapiens
gtgaagaatggccat

SEQ ID NO: 48364 - DNA, 15 bp, Homo sapiens
tgaagaatggccatc

SEQ ID NO: 48365 - DNA, 15 bp, Homo sapiens
gaagaatggccatcc

SEQ ID NO: 48366 - DNA, 15 bp, Homo sapiens
aagaatggccatcca

SEQ ID NO: 48367 - DNA, 15 bp, Homo sapiens
agaatggccatccat

SEQ ID NO: 48368 - DNA, 15 bp, Homo sapiens
gaatggccatccatt

SEQ ID NO: 48369 - DNA, 15 bp, Homo sapiens
aatggccatccattg

SEQ ID NO: 48370 - DNA, 15 bp, Homo sapiens
atggccatccattga

SEQ ID NO: 48371 - DNA, 15 bp, Homo sapiens
tggccatccattgag

SEQ ID NO: 48372 - DNA, 15 bp, Homo sapiens
ggccatccattgagt

SEQ ID NO: 48373 - DNA, 15 bp, Homo sapiens
gccatccattgagtc

SEQ ID NO: 48374 - DNA, 15 bp, Homo sapiens
ccatccattgagtct

SEQ ID NO: 48375 - DNA, 15 bp, Homo sapiens
catccattgagtctc

SEQ ID NO: 48376 - DNA, 15 bp, Homo sapiens
atccattgagtctct

SEQ ID NO: 48377 - DNA, 15 bp, Homo sapiens
tccattgagtctcta

SEQ ID NO: 48378 - DNA, 15 bp, Homo sapiens
ccattgagtctctag

SEQ ID NO: 48379 - DNA, 15 bp, Homo sapiens
cattgagtctctagc

SEQ ID NO: 48380 - DNA, 15 bp, Homo sapiens
attgagtctctagca

SEQ ID NO: 48381 - DNA, 15 bp, Homo sapiens
ttgagtctctagcac

SEQ ID NO: 48382 - DNA, 15 bp, Homo sapiens
tgagtctctagcacc

SEQ ID NO: 48383 - DNA, 15 bp, Homo sapiens
gagtctctagcacct

SEQ ID NO: 48384 - DNA, 15 bp, Homo sapiens
agtctctagcacctg

SEQ ID NO: 48385 - DNA, 15 bp, Homo sapiens
gtctctagcacctgg

SEQ ID NO: 48386 - DNA, 15 bp, Homo sapiens
tctctagcacctggg

SEQ ID NO: 48387 - DNA, 15 bp, Homo sapiens
ctctagcacctgggt

SEQ ID NO: 48388 - DNA, 15 bp, Homo sapiens
tctagcacctgggtc

SEQ ID NO: 48389 - DNA, 15 bp, Homo sapiens
ctagcacctgggtct

SEQ ID NO: 48390 - DNA, 15 bp, Homo sapiens
tagcacctgggtctc

SEQ ID NO: 48391 - DNA, 15 bp, Homo sapiens
agcacctgggtctcc

SEQ ID NO: 48392 - DNA, 15 bp, Homo sapiens
gcacctgggtctcct

SEQ ID NO: 48393 - DNA, 15 bp, Homo sapiens
cacctgggtctcctc

SEQ ID NO: 48394 - DNA, 15 bp, Homo sapiens
acctgggtctcctca

SEQ ID NO: 48395 - DNA, 15 bp, Homo sapiens
cctgggtctcctcaa

SEQ ID NO: 48396 - DNA, 15 bp, Homo sapiens
ctgggtctcctcaaa

SEQ ID NO: 48397 - DNA, 15 bp, Homo sapiens
tgggtctcctcaaaa

SEQ ID NO: 48398 - DNA, 15 bp, Homo sapiens
gggtctcctcaaaag

SEQ ID NO: 48399 - DNA, 15 bp, Homo sapiens
ggtctcctcaaaaga

SEQ ID NO: 48400 - DNA, 15 bp, Homo sapiens
gtctcctcaaaagac

SEQ ID NO: 48401 - DNA, 15 bp, Homo sapiens
tctcctcaaaagact

SEQ ID NO: 48402 - DNA, 15 bp, Homo sapiens
ctcctcaaaagactg

SEQ ID NO: 48403 - DNA, 15 bp, Homo sapiens
tcctcaaaagactgg

SEQ ID NO: 48404 - DNA, 15 bp, Homo sapiens
cctcaaaagactggt

SEQ ID NO: 48405 - DNA, 15 bp, Homo sapiens
ctcaaaagactggtc

SEQ ID NO: 48406 - DNA, 15 bp, Homo sapiens
tcaaaagactggtcc

SEQ ID NO: 48407 - DNA, 15 bp, Homo sapiens
caaaagactggtccc

SEQ ID NO: 48408 - DNA, 15 bp, Homo sapiens
aaaagactggtcccc

SEQ ID NO: 48409 - DNA, 15 bp, Homo sapiens
aaagactggtccccc

SEQ ID NO: 48410 - DNA, 15 bp, Homo sapiens
aagactggtccccct

SEQ ID NO: 48411 - DNA, 15 bp, Homo sapiens
agactggtccccctg

SEQ ID NO: 48412 - DNA, 15 bp, Homo sapiens
gactggtccccctgc

SEQ ID NO: 48413 - DNA, 15 bp, Homo sapiens
actggtccccctgcc

SEQ ID NO: 48414 - DNA, 15 bp, Homo sapiens
ctggtccccctgcct

SEQ ID NO: 48415 - DNA, 15 bp, Homo sapiens
tggtccccctgcctg

SEQ ID NO: 48416 - DNA, 15 bp, Homo sapiens
ggtccccctgcctgt

SEQ ID NO: 48417 - DNA, 15 bp, Homo sapiens
gtccccctgcctgtc

SEQ ID NO: 48418 - DNA, 15 bp, Homo sapiens
tccccctgcctgtca

SEQ ID NO: 48419 - DNA, 15 bp, Homo sapiens
ccccctgcctgtcac

SEQ ID NO: 48420 - DNA, 15 bp, Homo sapiens
cccctgcctgtcact

SEQ ID NO: 48421 - DNA, 15 bp, Homo sapiens
ccctgcctgtcactt

SEQ ID NO: 48422 - DNA, 15 bp, Homo sapiens
cctgcctgtcacttg

SEQ ID NO: 48423 - DNA, 15 bp, Homo sapiens
ctgcctgtcacttgg

SEQ ID NO: 48424 - DNA, 15 bp, Homo sapiens
tgcctgtcacttggc

SEQ ID NO: 48425 - DNA, 15 bp, Homo sapiens
gcctgtcacttggct

SEQ ID NO: 48426 - DNA, 15 bp, Homo sapiens
cctgtcacttggctc

SEQ ID NO: 48427 - DNA, 15 bp, Homo sapiens
ctgtcacttggctca

SEQ ID NO: 48428 - DNA, 15 bp, Homo sapiens
tgtcacttggctcag

SEQ ID NO: 48429 - DNA, 15 bp, Homo sapiens
gtcacttggctcagc

SEQ ID NO: 48430 - DNA, 15 bp, Homo sapiens
tcacttggctcagct

SEQ ID NO: 48431 - DNA, 15 bp, Homo sapiens
cacttggctcagctt

SEQ ID NO: 48432 - DNA, 15 bp, Homo sapiens
acttggctcagctta

SEQ ID NO: 48433 - DNA, 15 bp, Homo sapiens
cttggctcagcttaa

SEQ ID NO: 48434 - DNA, 15 bp, Homo sapiens
ttggctcagcttaag

SEQ ID NO: 48435 - DNA, 15 bp, Homo sapiens
tggctcagcttaaga

SEQ ID NO: 48436 - DNA, 15 bp, Homo sapiens
ggctcagcttaagaa

SEQ ID NO: 48437 - DNA, 15 bp, Homo sapiens
gctcagcttaagaac

SEQ ID NO: 48438 - DNA, 15 bp, Homo sapiens
ctcagcttaagaact

SEQ ID NO: 48439 - DNA, 15 bp, Homo sapiens
tcagcttaagaactt

SEQ ID NO: 48440 - DNA, 15 bp, Homo sapiens
cagcttaagaacttg

SEQ ID NO: 48441 - DNA, 15 bp, Homo sapiens
agcttaagaacttga

SEQ ID NO: 48442 - DNA, 15 bp, Homo sapiens
gcttaagaacttgaa

SEQ ID NO: 48443 - DNA, 15 bp, Homo sapiens
cttaagaacttgaag

SEQ ID NO: 48444 - DNA, 15 bp, Homo sapiens
ttaagaacttgaagt

SEQ ID NO: 48445 - DNA, 15 bp, Homo sapiens
taagaacttgaagtg

SEQ ID NO: 48446 - DNA, 15 bp, Homo sapiens
aagaacttgaagtgg

SEQ ID NO: 48447 - DNA, 15 bp, Homo sapiens
agaacttgaagtgga

SEQ ID NO: 48448 - DNA, 15 bp, Homo sapiens
gaacttgaagtggac

SEQ ID NO: 48449 - DNA, 15 bp, Homo sapiens
aacttgaagtggacc

SEQ ID NO: 48450 - DNA, 15 bp, Homo sapiens
acttgaagtggacca

SEQ ID NO: 48451 - DNA, 15 bp, Homo sapiens
cttgaagtggaccag

SEQ ID NO: 48452 - DNA, 15 bp, Homo sapiens
ttgaagtggaccagg

SEQ ID NO: 48453 - DNA, 15 bp, Homo sapiens
tgaagtggaccaggc

SEQ ID NO: 48454 - DNA, 15 bp, Homo sapiens
gaagtggaccaggcg

SEQ ID NO: 48455 - DNA, 15 bp, Homo sapiens
aagtggaccaggcgc

SEQ ID NO: 48456 - DNA, 15 bp, Homo sapiens
agtggaccaggcgca

SEQ ID NO: 48457 - DNA, 15 bp, Homo sapiens
gtggaccaggcgcag

SEQ ID NO: 48458 - DNA, 15 bp, Homo sapiens
tggaccaggcgcagt

SEQ ID NO: 48459 - DNA, 15 bp, Homo sapiens
ggaccaggcgcagtg

SEQ ID NO: 48460 - DNA, 15 bp, Homo sapiens
gaccaggcgcagtgg

SEQ ID NO: 48461 - DNA, 15 bp, Homo sapiens
accaggcgcagtggc

SEQ ID NO: 48462 - DNA, 15 bp, Homo sapiens
gcgcagtggctcaca

SEQ ID NO: 48463 - DNA, 15 bp, Homo sapiens
cgcagtggctcacac

SEQ ID NO: 48464 - DNA, 15 bp, Homo sapiens
taatcccaacacttt

SEQ ID NO: 48465 - DNA, 15 bp, Homo sapiens
aatcccaacactttg

SEQ ID NO: 48466 - DNA, 15 bp, Homo sapiens
atcccaacactttgg

SEQ ID NO: 48467 - DNA, 15 bp, Homo sapiens
tcccaacactttggg

SEQ ID NO: 48468 - DNA, 15 bp, Homo sapiens
ccaacactttgggaa

SEQ ID NO: 48469 - DNA, 15 bp, Homo sapiens
caacactttgggaag

SEQ ID NO: 48470 - DNA, 15 bp, Homo sapiens
aacactttgggaagc

SEQ ID NO: 48471 - DNA, 15 bp, Homo sapiens
acactttgggaagct

SEQ ID NO: 48472 - DNA, 15 bp, Homo sapiens
gaagctgaggcggga

SEQ ID NO: 48473 - DNA, 15 bp, Homo sapiens
aagctgaggcgggag

SEQ ID NO: 48474 - DNA, 15 bp, Homo sapiens
agctgaggcgggaga

SEQ ID NO: 48475 - DNA, 15 bp, Homo sapiens
gctgaggcgggagag

SEQ ID NO: 48476 - DNA, 15 bp, Homo sapiens
ctgaggcgggagagt

SEQ ID NO: 48477 - DNA, 15 bp, Homo sapiens
tgaggcgggagagtc

SEQ ID NO: 48478 - DNA, 15 bp, Homo sapiens
gaggcgggagagtca

SEQ ID NO: 48479 - DNA, 15 bp, Homo sapiens
aggcgggagagtcac

SEQ ID NO: 48480 - DNA, 15 bp, Homo sapiens
ggcgggagagtcact

SEQ ID NO: 48481 - DNA, 15 bp, Homo sapiens
gcgggagagtcactt

SEQ ID NO: 48482 - DNA, 15 bp, Homo sapiens
cgggagagtcacttg

SEQ ID NO: 48483 - DNA, 15 bp, Homo sapiens
gggagagtcacttga

SEQ ID NO: 48484 - DNA, 15 bp, Homo sapiens
ggagagtcacttgag

SEQ ID NO: 48485 - DNA, 15 bp, Homo sapiens
gagagtcacttgagg

SEQ ID NO: 48486 - DNA, 15 bp, Homo sapiens
agagtcacttgaggc

SEQ ID NO: 48487 - DNA, 15 bp, Homo sapiens
gagtcacttgaggcc

SEQ ID NO: 48488 - DNA, 15 bp, Homo sapiens
agtcacttgaggcct

SEQ ID NO: 48489 - DNA, 15 bp, Homo sapiens
gtcacttgaggccta

SEQ ID NO: 48490 - DNA, 15 bp, Homo sapiens
tcacttgaggcctag

SEQ ID NO: 48491 - DNA, 15 bp, Homo sapiens
cacttgaggcctaga

SEQ ID NO: 48492 - DNA, 15 bp, Homo sapiens
acttgaggcctagag

SEQ ID NO: 48493 - DNA, 15 bp, Homo sapiens
cttgaggcctagagt

SEQ ID NO: 48494 - DNA, 15 bp, Homo sapiens
ttgaggcctagagtt

SEQ ID NO: 48495 - DNA, 15 bp, Homo sapiens
tgaggcctagagttt

SEQ ID NO: 48496 - DNA, 15 bp, Homo sapiens
gaggcctagagttta

SEQ ID NO: 48497 - DNA, 15 bp, Homo sapiens
aggcctagagtttag

SEQ ID NO: 48498 - DNA, 15 bp, Homo sapiens
ggcctagagtttagg

SEQ ID NO: 48499 - DNA, 15 bp, Homo sapiens
gcctagagtttaggt

SEQ ID NO: 48500 - DNA, 15 bp, Homo sapiens
cctagagtttaggtt

SEQ ID NO: 48501 - DNA, 15 bp, Homo sapiens
ctagagtttaggttg

SEQ ID NO: 48502 - DNA, 15 bp, Homo sapiens
tagagtttaggttgc

SEQ ID NO: 48503 - DNA, 15 bp, Homo sapiens
agagtttaggttgca

SEQ ID NO: 48504 - DNA, 15 bp, Homo sapiens
gagtttaggttgcag

SEQ ID NO: 48505 - DNA, 15 bp, Homo sapiens
agtttaggttgcagc

SEQ ID NO: 48506 - DNA, 15 bp, Homo sapiens
gtttaggttgcagca

SEQ ID NO: 48507 - DNA, 15 bp, Homo sapiens
tttaggttgcagcat

SEQ ID NO: 48508 - DNA, 15 bp, Homo sapiens
ttaggttgcagcatc

SEQ ID NO: 48509 - DNA, 15 bp, Homo sapiens
taggttgcagcatca

SEQ ID NO: 48510 - DNA, 15 bp, Homo sapiens
aggttgcagcatcac

SEQ ID NO: 48511 - DNA, 15 bp, Homo sapiens
ggttgcagcatcact

SEQ ID NO: 48512 - DNA, 15 bp, Homo sapiens
gttgcagcatcactg

SEQ ID NO: 48513 - DNA, 15 bp, Homo sapiens
ttgcagcatcactgc

SEQ ID NO: 48514 - DNA, 15 bp, Homo sapiens
tgcagcatcactgca

SEQ ID NO: 48515 - DNA, 15 bp, Homo sapiens
gcagcatcactgcac

SEQ ID NO: 48516 - DNA, 15 bp, Homo sapiens
cagcatcactgcact

SEQ ID NO: 48517 - DNA, 15 bp, Homo sapiens
agcatcactgcactt

SEQ ID NO: 48518 - DNA, 15 bp, Homo sapiens
gcatcactgcacttg

SEQ ID NO: 48519 - DNA, 15 bp, Homo sapiens
catcactgcacttga

SEQ ID NO: 48520 - DNA, 15 bp, Homo sapiens
atcactgcacttgag

SEQ ID NO: 48521 - DNA, 15 bp, Homo sapiens
tcactgcacttgagc

SEQ ID NO: 48522 - DNA, 15 bp, Homo sapiens
cactgcacttgagcc

SEQ ID NO: 48523 - DNA, 15 bp, Homo sapiens
actgcacttgagcct

SEQ ID NO: 48524 - DNA, 15 bp, Homo sapiens
ctgcacttgagcctg

SEQ ID NO: 48525 - DNA, 15 bp, Homo sapiens
tgcacttgagcctgg

SEQ ID NO: 48526 - DNA, 15 bp, Homo sapiens
gcacttgagcctggg

SEQ ID NO: 48527 - DNA, 15 bp, Homo sapiens
cacttgagcctgggc

SEQ ID NO: 48528 - DNA, 15 bp, Homo sapiens
acttgagcctgggca

SEQ ID NO: 48529 - DNA, 15 bp, Homo sapiens
cttgagcctgggcaa

SEQ ID NO: 48530 - DNA, 15 bp, Homo sapiens
ttgagcctgggcaac

SEQ ID NO: 48531 - DNA, 15 bp, Homo sapiens
tgagcctgggcaaca

SEQ ID NO: 48532 - DNA, 15 bp, Homo sapiens
gagcctgggcaacag

SEQ ID NO: 48533 - DNA, 15 bp, Homo sapiens
ctgggcaacagagtc

SEQ ID NO: 48534 - DNA, 15 bp, Homo sapiens
tgggcaacagagtca

SEQ ID NO: 48535 - DNA, 15 bp, Homo sapiens
gggcaacagagtcag

SEQ ID NO: 48536 - DNA, 15 bp, Homo sapiens
ggcaacagagtcaga

SEQ ID NO: 48537 - DNA, 15 bp, Homo sapiens
gcaacagagtcagac

SEQ ID NO: 48538 - DNA, 15 bp, Homo sapiens
caacagagtcagacc

SEQ ID NO: 48539 - DNA, 15 bp, Homo sapiens
aacagagtcagaccc

SEQ ID NO: 48540 - DNA, 15 bp, Homo sapiens
acagagtcagacccc

SEQ ID NO: 48541 - DNA, 15 bp, Homo sapiens
cagagtcagacccca

SEQ ID NO: 48542 - DNA, 15 bp, Homo sapiens
agagtcagaccccat

SEQ ID NO: 48543 - DNA, 15 bp, Homo sapiens
gagtcagaccccatc

SEQ ID NO: 48544 - DNA, 15 bp, Homo sapiens
agtcagaccccatct

SEQ ID NO: 48545 - DNA, 15 bp, Homo sapiens
gtcagaccccatctc

SEQ ID NO: 48546 - DNA, 15 bp, Homo sapiens
tcagaccccatctca

SEQ ID NO: 48547 - DNA, 15 bp, Homo sapiens
cagaccccatctcaa

SEQ ID NO: 48548 - DNA, 15 bp, Homo sapiens
agaccccatctcaaa

SEQ ID NO: 48549 - DNA, 15 bp, Homo sapiens
gaccccatctcaaaa

SEQ ID NO: 48550 - DNA, 15 bp, Homo sapiens
accccatctcaaaaa

SEQ ID NO: 48551 - DNA, 15 bp, Homo sapiens
ccccatctcaaaaaa

SEQ ID NO: 48552 - DNA, 15 bp, Homo sapiens
cccatctcaaaaaaa

SEQ ID NO: 48553 - DNA, 15 bp, Homo sapiens
atctcaaaaaaaaat

SEQ ID NO: 48554 - DNA, 15 bp, Homo sapiens
ctcaaaaaaaaatta

SEQ ID NO: 48555 - DNA, 15 bp, Homo sapiens
tcaaaaaaaaattaa

SEQ ID NO: 48556 - DNA, 15 bp, Homo sapiens
caaaaaaaaattaag

SEQ ID NO: 48557 - DNA, 15 bp, Homo sapiens
aaaaaaaaattaagg

SEQ ID NO: 48558 - DNA, 15 bp, Homo sapiens
aaaaaaaattaaggc

SEQ ID NO: 48559 - DNA, 15 bp, Homo sapiens
aaaaaaattaaggcc

SEQ ID NO: 48560 - DNA, 15 bp, Homo sapiens
aaaaaattaaggcct

SEQ ID NO: 48561 - DNA, 15 bp, Homo sapiens
aaaaattaaggcctg

SEQ ID NO: 48562 - DNA, 15 bp, Homo sapiens
aaaattaaggcctga

SEQ ID NO: 48563 - DNA, 15 bp, Homo sapiens
aaattaaggcctgaa

SEQ ID NO: 48564 - DNA, 15 bp, Homo sapiens
aattaaggcctgaag

SEQ ID NO: 48565 - DNA, 15 bp, Homo sapiens
attaaggcctgaagt

SEQ ID NO: 48566 - DNA, 15 bp, Homo sapiens
ttaaggcctgaagtg

SEQ ID NO: 48567 - DNA, 15 bp, Homo sapiens
taaggcctgaagtgg

SEQ ID NO: 48568 - DNA, 15 bp, Homo sapiens
aaggcctgaagtggc

SEQ ID NO: 48569 - DNA, 15 bp, Homo sapiens
aggcctgaagtggct

SEQ ID NO: 48570 - DNA, 15 bp, Homo sapiens
ggcctgaagtggcta

SEQ ID NO: 48571 - DNA, 15 bp, Homo sapiens
gcctgaagtggctaa

SEQ ID NO: 48572 - DNA, 15 bp, Homo sapiens
cctgaagtggctaaa

SEQ ID NO: 48573 - DNA, 15 bp, Homo sapiens
ctgaagtggctaaac

SEQ ID NO: 48574 - DNA, 15 bp, Homo sapiens
tgaagtggctaaact

SEQ ID NO: 48575 - DNA, 15 bp, Homo sapiens
gaagtggctaaactt

SEQ ID NO: 48576 - DNA, 15 bp, Homo sapiens
aagtggctaaacttg

SEQ ID NO: 48577 - DNA, 15 bp, Homo sapiens
agtggctaaacttga

SEQ ID NO: 48578 - DNA, 15 bp, Homo sapiens
gtggctaaacttgaa

SEQ ID NO: 48579 - DNA, 15 bp, Homo sapiens
tggctaaacttgaag

SEQ ID NO: 48580 - DNA, 15 bp, Homo sapiens
ggctaaacttgaagg

SEQ ID NO: 48581 - DNA, 15 bp, Homo sapiens
gctaaacttgaagga

SEQ ID NO: 48582 - DNA, 15 bp, Homo sapiens
ctaaacttgaaggat

SEQ ID NO: 48583 - DNA, 15 bp, Homo sapiens
taaacttgaaggata

SEQ ID NO: 48584 - DNA, 15 bp, Homo sapiens
aaacttgaaggataa

SEQ ID NO: 48585 - DNA, 15 bp, Homo sapiens
aacttgaaggataac

SEQ ID NO: 48586 - DNA, 15 bp, Homo sapiens
acttgaaggataact

SEQ ID NO: 48587 - DNA, 15 bp, Homo sapiens
cttgaaggataactc

SEQ ID NO: 48588 - DNA, 15 bp, Homo sapiens
ttgaaggataactcc

SEQ ID NO: 48589 - DNA, 15 bp, Homo sapiens
tgaaggataactccc

SEQ ID NO: 48590 - DNA, 15 bp, Homo sapiens
gaaggataactccct

SEQ ID NO: 48591 - DNA, 15 bp, Homo sapiens
aaggataactccctt

SEQ ID NO: 48592 - DNA, 15 bp, Homo sapiens
aggataactcccttt

SEQ ID NO: 48593 - DNA, 15 bp, Homo sapiens
ggataactcccttta

SEQ ID NO: 48594 - DNA, 15 bp, Homo sapiens
gataactccctttat

SEQ ID NO: 48595 - DNA, 15 bp, Homo sapiens
ataactccctttatc

SEQ ID NO: 48596 - DNA, 15 bp, Homo sapiens
taactccctttatct

SEQ ID NO: 48597 - DNA, 15 bp, Homo sapiens
aactccctttatctt

SEQ ID NO: 48598 - DNA, 15 bp, Homo sapiens
actccctttatctta

SEQ ID NO: 48599 - DNA, 15 bp, Homo sapiens
ctccctttatcttat

SEQ ID NO: 48600 - DNA, 15 bp, Homo sapiens
tccctttatcttatc

SEQ ID NO: 48601 - DNA, 15 bp, Homo sapiens
ccctttatcttatcc

SEQ ID NO: 48602 - DNA, 15 bp, Homo sapiens
cctttatcttatcct

SEQ ID NO: 48603 - DNA, 15 bp, Homo sapiens
ctttatcttatcctg

SEQ ID NO: 48604 - DNA, 15 bp, Homo sapiens
tttatcttatcctgg

SEQ ID NO: 48605 - DNA, 15 bp, Homo sapiens
ttatcttatcctggc

SEQ ID NO: 48606 - DNA, 15 bp, Homo sapiens
tatcttatcctggcc

SEQ ID NO: 48607 - DNA, 15 bp, Homo sapiens
atcttatcctggcca

SEQ ID NO: 48608 - DNA, 15 bp, Homo sapiens
tcttatcctggccaa

SEQ ID NO: 48609 - DNA, 15 bp, Homo sapiens
cttatcctggccaaa

SEQ ID NO: 48610 - DNA, 15 bp, Homo sapiens
ttatcctggccaaag

SEQ ID NO: 48611 - DNA, 15 bp, Homo sapiens
tatcctggccaaagt

SEQ ID NO: 48612 - DNA, 15 bp, Homo sapiens
atcctggccaaagtg

SEQ ID NO: 48613 - DNA, 15 bp, Homo sapiens
tcctggccaaagtgg

SEQ ID NO: 48614 - DNA, 15 bp, Homo sapiens
cctggccaaagtggt

SEQ ID NO: 48615 - DNA, 15 bp, Homo sapiens
ctggccaaagtggta

SEQ ID NO: 48616 - DNA, 15 bp, Homo sapiens
tggccaaagtggtag

SEQ ID NO: 48617 - DNA, 15 bp, Homo sapiens
ggccaaagtggtaga

SEQ ID NO: 48618 - DNA, 15 bp, Homo sapiens
gccaaagtggtagat

SEQ ID NO: 48619 - DNA, 15 bp, Homo sapiens
ccaaagtggtagatg

SEQ ID NO: 48620 - DNA, 15 bp, Homo sapiens
caaagtggtagatga

SEQ ID NO: 48621 - DNA, 15 bp, Homo sapiens
aaagtggtagatgat

SEQ ID NO: 48622 - DNA, 15 bp, Homo sapiens
aagtggtagatgatt

SEQ ID NO: 48623 - DNA, 15 bp, Homo sapiens
agtggtagatgattg

SEQ ID NO: 48624 - DNA, 15 bp, Homo sapiens
gtggtagatgattgc

SEQ ID NO: 48625 - DNA, 15 bp, Homo sapiens
tggtagatgattgct

SEQ ID NO: 48626 - DNA, 15 bp, Homo sapiens
ggtagatgattgctt

SEQ ID NO: 48627 - DNA, 15 bp, Homo sapiens
gtagatgattgcttg

SEQ ID NO: 48628 - DNA, 15 bp, Homo sapiens
tagatgattgcttgg

SEQ ID NO: 48629 - DNA, 15 bp, Homo sapiens
agatgattgcttgga

SEQ ID NO: 48630 - DNA, 15 bp, Homo sapiens
gatgattgcttggat

SEQ ID NO: 48631 - DNA, 15 bp, Homo sapiens
atgattgcttggatg

SEQ ID NO: 48632 - DNA, 15 bp, Homo sapiens
tgattgcttggatga

SEQ ID NO: 48633 - DNA, 15 bp, Homo sapiens
gattgcttggatgag

SEQ ID NO: 48634 - DNA, 15 bp, Homo sapiens
attgcttggatgaga

SEQ ID NO: 48635 - DNA, 15 bp, Homo sapiens
ttgcttggatgagaa

SEQ ID NO: 48636 - DNA, 15 bp, Homo sapiens
tgcttggatgagaag

SEQ ID NO: 48637 - DNA, 15 bp, Homo sapiens
gcttggatgagaagt

SEQ ID NO: 48638 - DNA, 15 bp, Homo sapiens
cttggatgagaagtg

SEQ ID NO: 48639 - DNA, 15 bp, Homo sapiens
ttggatgagaagtga

SEQ ID NO: 48640 - DNA, 15 bp, Homo sapiens
tggatgagaagtgat

SEQ ID NO: 48641 - DNA, 15 bp, Homo sapiens
ggatgagaagtgata

SEQ ID NO: 48642 - DNA, 15 bp, Homo sapiens
gatgagaagtgatat

SEQ ID NO: 48643 - DNA, 15 bp, Homo sapiens
atgagaagtgatatg

SEQ ID NO: 48644 - DNA, 15 bp, Homo sapiens
tgagaagtgatatgc

SEQ ID NO: 48645 - DNA, 15 bp, Homo sapiens
gagaagtgatatgca

SEQ ID NO: 48646 - DNA, 15 bp, Homo sapiens
agaagtgatatgcag

SEQ ID NO: 48647 - DNA, 15 bp, Homo sapiens
gaagtgatatgcaga

SEQ ID NO: 48648 - DNA, 15 bp, Homo sapiens
aagtgatatgcagat

SEQ ID NO: 48649 - DNA, 15 bp, Homo sapiens
agtgatatgcagata

SEQ ID NO: 48650 - DNA, 15 bp, Homo sapiens
gtgatatgcagataa

SEQ ID NO: 48651 - DNA, 15 bp, Homo sapiens
tgatatgcagataag

SEQ ID NO: 48652 - DNA, 15 bp, Homo sapiens
gatatgcagataaga

SEQ ID NO: 48653 - DNA, 15 bp, Homo sapiens
atatgcagataagat

SEQ ID NO: 48654 - DNA, 15 bp, Homo sapiens
tatgcagataagatg

SEQ ID NO: 48655 - DNA, 15 bp, Homo sapiens
atgcagataagatgt

SEQ ID NO: 48656 - DNA, 15 bp, Homo sapiens
tgcagataagatgtt

SEQ ID NO: 48657 - DNA, 15 bp, Homo sapiens
gcagataagatgttg

SEQ ID NO: 48658 - DNA, 15 bp, Homo sapiens
cagataagatgttgc

SEQ ID NO: 48659 - DNA, 15 bp, Homo sapiens
agataagatgttgca

SEQ ID NO: 48660 - DNA, 15 bp, Homo sapiens
gataagatgttgcaa

SEQ ID NO: 48661 - DNA, 15 bp, Homo sapiens
ataagatgttgcaat

SEQ ID NO: 48662 - DNA, 15 bp, Homo sapiens
taagatgttgcaata

SEQ ID NO: 48663 - DNA, 15 bp, Homo sapiens
aagatgttgcaatac

SEQ ID NO: 48664 - DNA, 15 bp, Homo sapiens
agatgttgcaataca

SEQ ID NO: 48665 - DNA, 15 bp, Homo sapiens
gatgttgcaatacac

SEQ ID NO: 48666 - DNA, 15 bp, Homo sapiens
atgttgcaatacaca

SEQ ID NO: 48667 - DNA, 15 bp, Homo sapiens
tgttgcaatacacaa

SEQ ID NO: 48668 - DNA, 15 bp, Homo sapiens
gttgcaatacacaaa

SEQ ID NO: 48669 - DNA, 15 bp, Homo sapiens
ttgcaatacacaaag

SEQ ID NO: 48670 - DNA, 15 bp, Homo sapiens
tgcaatacacaaagt

SEQ ID NO: 48671 - DNA, 15 bp, Homo sapiens
gcaatacacaaagtc

SEQ ID NO: 48672 - DNA, 15 bp, Homo sapiens
caatacacaaagtct

SEQ ID NO: 48673 - DNA, 15 bp, Homo sapiens
aatacacaaagtctg

SEQ ID NO: 48674 - DNA, 15 bp, Homo sapiens
atacacaaagtctgt

SEQ ID NO: 48675 - DNA, 15 bp, Homo sapiens
tacacaaagtctgtg

SEQ ID NO: 48676 - DNA, 15 bp, Homo sapiens
acacaaagtctgtgt

SEQ ID NO: 48677 - DNA, 15 bp, Homo sapiens
cacaaagtctgtgtg

SEQ ID NO: 48678 - DNA, 15 bp, Homo sapiens
acaaagtctgtgtgg

SEQ ID NO: 48679 - DNA, 15 bp, Homo sapiens
caaagtctgtgtggg

SEQ ID NO: 48680 - DNA, 15 bp, Homo sapiens
aaagtctgtgtgggt

SEQ ID NO: 48681 - DNA, 15 bp, Homo sapiens
aagtctgtgtgggtc

SEQ ID NO: 48682 - DNA, 15 bp, Homo sapiens
agtctgtgtgggtca

SEQ ID NO: 48683 - DNA, 15 bp, Homo sapiens
gtctgtgtgggtcag

SEQ ID NO: 48684 - DNA, 15 bp, Homo sapiens
tctgtgtgggtcagt

SEQ ID NO: 48685 - DNA, 15 bp, Homo sapiens
ctgtgtgggtcagtc

SEQ ID NO: 48686 - DNA, 15 bp, Homo sapiens
tgtgtgggtcagtcg

SEQ ID NO: 48687 - DNA, 15 bp, Homo sapiens
gtgtgggtcagtcgg

SEQ ID NO: 48688 - DNA, 15 bp, Homo sapiens
tgtgggtcagtcggt

SEQ ID NO: 48689 - DNA, 15 bp, Homo sapiens
gtgggtcagtcggtc

SEQ ID NO: 48690 - DNA, 15 bp, Homo sapiens
tgggtcagtcggtca

SEQ ID NO: 48691 - DNA, 15 bp, Homo sapiens
gggtcagtcggtcac

SEQ ID NO: 48692 - DNA, 15 bp, Homo sapiens
ggtcagtcggtcacg

SEQ ID NO: 48693 - DNA, 15 bp, Homo sapiens
gtcagtcggtcacgt

SEQ ID NO: 48694 - DNA, 15 bp, Homo sapiens
tcagtcggtcacgtg

SEQ ID NO: 48695 - DNA, 15 bp, Homo sapiens
cagtcggtcacgtgg

SEQ ID NO: 48696 - DNA, 15 bp, Homo sapiens
agtcggtcacgtggg

SEQ ID NO: 48697 - DNA, 15 bp, Homo sapiens
gtcggtcacgtgggt

SEQ ID NO: 48698 - DNA, 15 bp, Homo sapiens
tcggtcacgtgggtg

SEQ ID NO: 48699 - DNA, 15 bp, Homo sapiens
cggtcacgtgggtgc

SEQ ID NO: 48700 - DNA, 15 bp, Homo sapiens
ggtcacgtgggtgcc

SEQ ID NO: 48701 - DNA, 15 bp, Homo sapiens
gtcacgtgggtgcca

SEQ ID NO: 48702 - DNA, 15 bp, Homo sapiens
tcacgtgggtgccaa

SEQ ID NO: 48703 - DNA, 15 bp, Homo sapiens
cacgtgggtgccaag

SEQ ID NO: 48704 - DNA, 15 bp, Homo sapiens
acgtgggtgccaagg

SEQ ID NO: 48705 - DNA, 15 bp, Homo sapiens
cgtgggtgccaagga

SEQ ID NO: 48706 - DNA, 15 bp, Homo sapiens
gtgggtgccaaggac

SEQ ID NO: 48707 - DNA, 15 bp, Homo sapiens
tgggtgccaaggaca

SEQ ID NO: 48708 - DNA, 15 bp, Homo sapiens
gggtgccaaggacag

SEQ ID NO: 48709 - DNA, 15 bp, Homo sapiens
ggtgccaaggacagg

SEQ ID NO: 48710 - DNA, 15 bp, Homo sapiens
gtgccaaggacaggt

SEQ ID NO: 48711 - DNA, 15 bp, Homo sapiens
tgccaaggacaggtg

SEQ ID NO: 48712 - DNA, 15 bp, Homo sapiens
gccaaggacaggtgg

SEQ ID NO: 48713 - DNA, 15 bp, Homo sapiens
ccaaggacaggtggg

SEQ ID NO: 48714 - DNA, 15 bp, Homo sapiens
caaggacaggtggga

SEQ ID NO: 48715 - DNA, 15 bp, Homo sapiens
aaggacaggtgggag

SEQ ID NO: 48716 - DNA, 15 bp, Homo sapiens
aggacaggtgggaga

SEQ ID NO: 48717 - DNA, 15 bp, Homo sapiens
ggacaggtgggagag

SEQ ID NO: 48718 - DNA, 15 bp, Homo sapiens
gacaggtgggagaga

SEQ ID NO: 48719 - DNA, 15 bp, Homo sapiens
acaggtgggagagaa

SEQ ID NO: 48720 - DNA, 15 bp, Homo sapiens
caggtgggagagaag

SEQ ID NO: 48721 - DNA, 15 bp, Homo sapiens
aggtgggagagaaga

SEQ ID NO: 48722 - DNA, 15 bp, Homo sapiens
ggtgggagagaagaa

SEQ ID NO: 48723 - DNA, 15 bp, Homo sapiens
gtgggagagaagaag

SEQ ID NO: 48724 - DNA, 15 bp, Homo sapiens
tgggagagaagaagc

SEQ ID NO: 48725 - DNA, 15 bp, Homo sapiens
gggagagaagaagca

SEQ ID NO: 48726 - DNA, 15 bp, Homo sapiens
ggagagaagaagcaa

SEQ ID NO: 48727 - DNA, 15 bp, Homo sapiens
gagagaagaagcaag

SEQ ID NO: 48728 - DNA, 15 bp, Homo sapiens
agagaagaagcaagc

SEQ ID NO: 48729 - DNA, 15 bp, Homo sapiens
gagaagaagcaagct

SEQ ID NO: 48730 - DNA, 15 bp, Homo sapiens
agaagaagcaagcta

SEQ ID NO: 48731 - DNA, 15 bp, Homo sapiens
gaagaagcaagctac

SEQ ID NO: 48732 - DNA, 15 bp, Homo sapiens
aagaagcaagctaca

SEQ ID NO: 48733 - DNA, 15 bp, Homo sapiens
agaagcaagctacag

SEQ ID NO: 48734 - DNA, 15 bp, Homo sapiens
gaagcaagctacaga

SEQ ID NO: 48735 - DNA, 15 bp, Homo sapiens
aagcaagctacagaa

SEQ ID NO: 48736 - DNA, 15 bp, Homo sapiens
agcaagctacagaag

SEQ ID NO: 48737 - DNA, 15 bp, Homo sapiens
gcaagctacagaagc

SEQ ID NO: 48738 - DNA, 15 bp, Homo sapiens
caagctacagaagca

SEQ ID NO: 48739 - DNA, 15 bp, Homo sapiens
aagctacagaagcag

SEQ ID NO: 48740 - DNA, 15 bp, Homo sapiens
agctacagaagcagc

SEQ ID NO: 48741 - DNA, 15 bp, Homo sapiens
gctacagaagcagct

SEQ ID NO: 48742 - DNA, 15 bp, Homo sapiens
ctacagaagcagctc

SEQ ID NO: 48743 - DNA, 15 bp, Homo sapiens
tacagaagcagctca

SEQ ID NO: 48744 - DNA, 15 bp, Homo sapiens
acagaagcagctcaa

SEQ ID NO: 48745 - DNA, 15 bp, Homo sapiens
cagaagcagctcaag

SEQ ID NO: 48746 - DNA, 15 bp, Homo sapiens
agaagcagctcaaga

SEQ ID NO: 48747 - DNA, 15 bp, Homo sapiens
gaagcagctcaagaa

SEQ ID NO: 48748 - DNA, 15 bp, Homo sapiens
aagcagctcaagaat

SEQ ID NO: 48749 - DNA, 15 bp, Homo sapiens
agcagctcaagaatg

SEQ ID NO: 48750 - DNA, 15 bp, Homo sapiens
gcagctcaagaatgg

SEQ ID NO: 48751 - DNA, 15 bp, Homo sapiens
cagctcaagaatggg

SEQ ID NO: 48752 - DNA, 15 bp, Homo sapiens
agctcaagaatggga

SEQ ID NO: 48753 - DNA, 15 bp, Homo sapiens
gctcaagaatgggaa

SEQ ID NO: 48754 - DNA, 15 bp, Homo sapiens
ctcaagaatgggaac

SEQ ID NO: 48755 - DNA, 15 bp, Homo sapiens
tcaagaatgggaact

SEQ ID NO: 48756 - DNA, 15 bp, Homo sapiens
caagaatgggaactg

SEQ ID NO: 48757 - DNA, 15 bp, Homo sapiens
aagaatgggaactgc

SEQ ID NO: 48758 - DNA, 15 bp, Homo sapiens
agaatgggaactgcg

SEQ ID NO: 48759 - DNA, 15 bp, Homo sapiens
gaatgggaactgcgg

SEQ ID NO: 48760 - DNA, 15 bp, Homo sapiens
aatgggaactgcgga

SEQ ID NO: 48761 - DNA, 15 bp, Homo sapiens
atgggaactgcggaa

SEQ ID NO: 48762 - DNA, 15 bp, Homo sapiens
tgggaactgcggaag

SEQ ID NO: 48763 - DNA, 15 bp, Homo sapiens
gggaactgcggaagc

SEQ ID NO: 48764 - DNA, 15 bp, Homo sapiens
ggaactgcggaagct

SEQ ID NO: 48765 - DNA, 15 bp, Homo sapiens
gaactgcggaagctg

SEQ ID NO: 48766 - DNA, 15 bp, Homo sapiens
aactgcggaagctga

SEQ ID NO: 48767 - DNA, 15 bp, Homo sapiens
actgcggaagctgat

SEQ ID NO: 48768 - DNA, 15 bp, Homo sapiens
ctgcggaagctgatt

SEQ ID NO: 48769 - DNA, 15 bp, Homo sapiens
tgcggaagctgattg

SEQ ID NO: 48770 - DNA, 15 bp, Homo sapiens
gcggaagctgattgt

SEQ ID NO: 48771 - DNA, 15 bp, Homo sapiens
cggaagctgattgta

SEQ ID NO: 48772 - DNA, 15 bp, Homo sapiens
ggaagctgattgtat

SEQ ID NO: 48773 - DNA, 15 bp, Homo sapiens
gaagctgattgtatt

SEQ ID NO: 48774 - DNA, 15 bp, Homo sapiens
aagctgattgtattg

SEQ ID NO: 48775 - DNA, 15 bp, Homo sapiens
agctgattgtattgg

SEQ ID NO: 48776 - DNA, 15 bp, Homo sapiens
gctgattgtattgga

SEQ ID NO: 48777 - DNA, 15 bp, Homo sapiens
ctgattgtattggag

SEQ ID NO: 48778 - DNA, 15 bp, Homo sapiens
tgattgtattggagg

SEQ ID NO: 48779 - DNA, 15 bp, Homo sapiens
gattgtattggagga

SEQ ID NO: 48780 - DNA, 15 bp, Homo sapiens
attgtattggaggaa

SEQ ID NO: 48781 - DNA, 15 bp, Homo sapiens
ttgtattggaggaag

SEQ ID NO: 48782 - DNA, 15 bp, Homo sapiens
tgtattggaggaagg

SEQ ID NO: 48783 - DNA, 15 bp, Homo sapiens
gtattggaggaagga

SEQ ID NO: 48784 - DNA, 15 bp, Homo sapiens
tattggaggaaggag

SEQ ID NO: 48785 - DNA, 15 bp, Homo sapiens
attggaggaaggagt

SEQ ID NO: 48786 - DNA, 15 bp, Homo sapiens
ttggaggaaggagtg

SEQ ID NO: 48787 - DNA, 15 bp, Homo sapiens
tggaggaaggagtgt

SEQ ID NO: 48788 - DNA, 15 bp, Homo sapiens
ggaggaaggagtgtg

SEQ ID NO: 48789 - DNA, 15 bp, Homo sapiens
gaggaaggagtgtga

SEQ ID NO: 48790 - DNA, 15 bp, Homo sapiens
aggaaggagtgtgat

SEQ ID NO: 48791 - DNA, 15 bp, Homo sapiens
ggaaggagtgtgatg

SEQ ID NO: 48792 - DNA, 15 bp, Homo sapiens
gaaggagtgtgatgc

SEQ ID NO: 48793 - DNA, 15 bp, Homo sapiens
aaggagtgtgatgct

SEQ ID NO: 48794 - DNA, 15 bp, Homo sapiens
aggagtgtgatgctc

SEQ ID NO: 48795 - DNA, 15 bp, Homo sapiens
ggagtgtgatgctct

SEQ ID NO: 48796 - DNA, 15 bp, Homo sapiens
gagtgtgatgctctc

SEQ ID NO: 48797 - DNA, 15 bp, Homo sapiens
agtgtgatgctctca

SEQ ID NO: 48798 - DNA, 15 bp, Homo sapiens
gtgtgatgctctcag

SEQ ID NO: 48799 - DNA, 15 bp, Homo sapiens
tgtgatgctctcaga

SEQ ID NO: 48800 - DNA, 15 bp, Homo sapiens
gtgatgctctcagag

SEQ ID NO: 48801 - DNA, 15 bp, Homo sapiens
tgatgctctcagagc

SEQ ID NO: 48802 - DNA, 15 bp, Homo sapiens
gatgctctcagagca

SEQ ID NO: 48803 - DNA, 15 bp, Homo sapiens
atgctctcagagcag

SEQ ID NO: 48804 - DNA, 15 bp, Homo sapiens
tgctctcagagcagc

SEQ ID NO: 48805 - DNA, 15 bp, Homo sapiens
gctctcagagcagcc

SEQ ID NO: 48806 - DNA, 15 bp, Homo sapiens
ctctcagagcagcca

SEQ ID NO: 48807 - DNA, 15 bp, Homo sapiens
tctcagagcagccag

SEQ ID NO: 48808 - DNA, 15 bp, Homo sapiens
ctcagagcagccagg

SEQ ID NO: 48809 - DNA, 15 bp, Homo sapiens
tcagagcagccaggg

SEQ ID NO: 48810 - DNA, 15 bp, Homo sapiens
cagagcagccaggga

SEQ ID NO: 48811 - DNA, 15 bp, Homo sapiens
agagcagccagggag

SEQ ID NO: 48812 - DNA, 15 bp, Homo sapiens
gagcagccagggagg

SEQ ID NO: 48813 - DNA, 15 bp, Homo sapiens
agcagccagggagga

SEQ ID NO: 48814 - DNA, 15 bp, Homo sapiens
gcagccagggaggag

SEQ ID NO: 48815 - DNA, 15 bp, Homo sapiens
cagccagggaggagc

SEQ ID NO: 48816 - DNA, 15 bp, Homo sapiens
agccagggaggagca

SEQ ID NO: 48817 - DNA, 15 bp, Homo sapiens
gccagggaggagcag

SEQ ID NO: 48818 - DNA, 15 bp, Homo sapiens
ccagggaggagcaga

SEQ ID NO: 48819 - DNA, 15 bp, Homo sapiens
cagggaggagcagaa

SEQ ID NO: 48820 - DNA, 15 bp, Homo sapiens
agggaggagcagaag

SEQ ID NO: 48821 - DNA, 15 bp, Homo sapiens
gggaggagcagaagg

SEQ ID NO: 48822 - DNA, 15 bp, Homo sapiens
ggaggagcagaagga

SEQ ID NO: 48823 - DNA, 15 bp, Homo sapiens
gaggagcagaaggag

SEQ ID NO: 48824 - DNA, 15 bp, Homo sapiens
aggagcagaaggagc

SEQ ID NO: 48825 - DNA, 15 bp, Homo sapiens
ggagcagaaggagct

SEQ ID NO: 48826 - DNA, 15 bp, Homo sapiens
gagcagaaggagctt

SEQ ID NO: 48827 - DNA, 15 bp, Homo sapiens
agcagaaggagctta

SEQ ID NO: 48828 - DNA, 15 bp, Homo sapiens
gcagaaggagcttag

SEQ ID NO: 48829 - DNA, 15 bp, Homo sapiens
cagaaggagcttagg

SEQ ID NO: 48830 - DNA, 15 bp, Homo sapiens
agaaggagcttaggg

SEQ ID NO: 48831 - DNA, 15 bp, Homo sapiens
gaaggagcttaggga

SEQ ID NO: 48832 - DNA, 15 bp, Homo sapiens
aaggagcttagggac

SEQ ID NO: 48833 - DNA, 15 bp, Homo sapiens
aggagcttagggacg

SEQ ID NO: 48834 - DNA, 15 bp, Homo sapiens
ggagcttagggacgt

SEQ ID NO: 48835 - DNA, 15 bp, Homo sapiens
gagcttagggacgta

SEQ ID NO: 48836 - DNA, 15 bp, Homo sapiens
agcttagggacgtaa

SEQ ID NO: 48837 - DNA, 15 bp, Homo sapiens
gcttagggacgtaag

SEQ ID NO: 48838 - DNA, 15 bp, Homo sapiens
cttagggacgtaagt

SEQ ID NO: 48839 - DNA, 15 bp, Homo sapiens
ttagggacgtaagtc

SEQ ID NO: 48840 - DNA, 15 bp, Homo sapiens
tagggacgtaagtca

SEQ ID NO: 48841 - DNA, 15 bp, Homo sapiens
agggacgtaagtcag

SEQ ID NO: 48842 - DNA, 15 bp, Homo sapiens
gggacgtaagtcagg

SEQ ID NO: 48843 - DNA, 15 bp, Homo sapiens
ggacgtaagtcaggc

SEQ ID NO: 48844 - DNA, 15 bp, Homo sapiens
gacgtaagtcaggct

SEQ ID NO: 48845 - DNA, 15 bp, Homo sapiens
acgtaagtcaggctc

SEQ ID NO: 48846 - DNA, 15 bp, Homo sapiens
cgtaagtcaggctct

SEQ ID NO: 48847 - DNA, 15 bp, Homo sapiens
gtaagtcaggctctc

SEQ ID NO: 48848 - DNA, 15 bp, Homo sapiens
taagtcaggctctca

SEQ ID NO: 48849 - DNA, 15 bp, Homo sapiens
aagtcaggctctcaa

SEQ ID NO: 48850 - DNA, 15 bp, Homo sapiens
agtcaggctctcaaa

SEQ ID NO: 48851 - DNA, 15 bp, Homo sapiens
gtcaggctctcaaag

SEQ ID NO: 48852 - DNA, 15 bp, Homo sapiens
tcaggctctcaaagt

SEQ ID NO: 48853 - DNA, 15 bp, Homo sapiens
caggctctcaaagtc

SEQ ID NO: 48854 - DNA, 15 bp, Homo sapiens
aggctctcaaagtct

SEQ ID NO: 48855 - DNA, 15 bp, Homo sapiens
ggctctcaaagtcta

SEQ ID NO: 48856 - DNA, 15 bp, Homo sapiens
gctctcaaagtctat

SEQ ID NO: 48857 - DNA, 15 bp, Homo sapiens
ctctcaaagtctatg

SEQ ID NO: 48858 - DNA, 15 bp, Homo sapiens
tctcaaagtctatgt

SEQ ID NO: 48859 - DNA, 15 bp, Homo sapiens
ctcaaagtctatgtc

SEQ ID NO: 48860 - DNA, 15 bp, Homo sapiens
tcaaagtctatgtct

SEQ ID NO: 48861 - DNA, 15 bp, Homo sapiens
caaagtctatgtctg

SEQ ID NO: 48862 - DNA, 15 bp, Homo sapiens
aaagtctatgtctgg

SEQ ID NO: 48863 - DNA, 15 bp, Homo sapiens
aagtctatgtctggt

SEQ ID NO: 48864 - DNA, 15 bp, Homo sapiens
agtctatgtctggtt

SEQ ID NO: 48865 - DNA, 15 bp, Homo sapiens
gtctatgtctggttc

SEQ ID NO: 48866 - DNA, 15 bp, Homo sapiens
tctatgtctggttcc

SEQ ID NO: 48867 - DNA, 15 bp, Homo sapiens
ctatgtctggttcct

SEQ ID NO: 48868 - DNA, 15 bp, Homo sapiens
tatgtctggttcctg

SEQ ID NO: 48869 - DNA, 15 bp, Homo sapiens
atgtctggttcctgc

SEQ ID NO: 48870 - DNA, 15 bp, Homo sapiens
tgtctggttcctgcc

SEQ ID NO: 48871 - DNA, 15 bp, Homo sapiens
gtctggttcctgccc

SEQ ID NO: 48872 - DNA, 15 bp, Homo sapiens
tctggttcctgcccc

SEQ ID NO: 48873 - DNA, 15 bp, Homo sapiens
ctggttcctgccccc

SEQ ID NO: 48874 - DNA, 15 bp, Homo sapiens
tggttcctgccccca

SEQ ID NO: 48875 - DNA, 15 bp, Homo sapiens
ggttcctgcccccac

SEQ ID NO: 48876 - DNA, 15 bp, Homo sapiens
gttcctgcccccaca

SEQ ID NO: 48877 - DNA, 15 bp, Homo sapiens
ttcctgcccccacaa

SEQ ID NO: 48878 - DNA, 15 bp, Homo sapiens
tcctgcccccacaaa

SEQ ID NO: 48879 - DNA, 15 bp, Homo sapiens
cctgcccccacaaac

SEQ ID NO: 48880 - DNA, 15 bp, Homo sapiens
ctgcccccacaaacc

SEQ ID NO: 48881 - DNA, 15 bp, Homo sapiens
tgcccccacaaacca

SEQ ID NO: 48882 - DNA, 15 bp, Homo sapiens
gcccccacaaaccac

SEQ ID NO: 48883 - DNA, 15 bp, Homo sapiens
cccccacaaaccacc

SEQ ID NO: 48884 - DNA, 15 bp, Homo sapiens
ccccacaaaccacca

SEQ ID NO: 48885 - DNA, 15 bp, Homo sapiens
cccacaaaccaccac

SEQ ID NO: 48886 - DNA, 15 bp, Homo sapiens
ccacaaaccaccacc

SEQ ID NO: 48887 - DNA, 15 bp, Homo sapiens
cacaaaccaccaccc

SEQ ID NO: 48888 - DNA, 15 bp, Homo sapiens
acaaaccaccaccca

SEQ ID NO: 48889 - DNA, 15 bp, Homo sapiens
caaaccaccacccag

SEQ ID NO: 48890 - DNA, 15 bp, Homo sapiens
aaaccaccacccagg

SEQ ID NO: 48891 - DNA, 15 bp, Homo sapiens
aaccaccacccagga

SEQ ID NO: 48892 - DNA, 15 bp, Homo sapiens
accaccacccaggaa

SEQ ID NO: 48893 - DNA, 15 bp, Homo sapiens
ccaccacccaggaaa

SEQ ID NO: 48894 - DNA, 15 bp, Homo sapiens
caccacccaggaaac

SEQ ID NO: 48895 - DNA, 15 bp, Homo sapiens
accacccaggaaaca

SEQ ID NO: 48896 - DNA, 15 bp, Homo sapiens
ccacccaggaaacat

SEQ ID NO: 48897 - DNA, 15 bp, Homo sapiens
cacccaggaaacatc

SEQ ID NO: 48898 - DNA, 15 bp, Homo sapiens
acccaggaaacatca

SEQ ID NO: 48899 - DNA, 15 bp, Homo sapiens
cccaggaaacatcat

SEQ ID NO: 48900 - DNA, 15 bp, Homo sapiens
ccaggaaacatcatt

SEQ ID NO: 48901 - DNA, 15 bp, Homo sapiens
caggaaacatcattc

SEQ ID NO: 48902 - DNA, 15 bp, Homo sapiens
aggaaacatcattcc

SEQ ID NO: 48903 - DNA, 15 bp, Homo sapiens
ggaaacatcattcct

SEQ ID NO: 48904 - DNA, 15 bp, Homo sapiens
gaaacatcattcctg

SEQ ID NO: 48905 - DNA, 15 bp, Homo sapiens
aaacatcattcctga

SEQ ID NO: 48906 - DNA, 15 bp, Homo sapiens
aacatcattcctgag

SEQ ID NO: 48907 - DNA, 15 bp, Homo sapiens
acatcattcctgagc

SEQ ID NO: 48908 - DNA, 15 bp, Homo sapiens
catcattcctgagct

SEQ ID NO: 48909 - DNA, 15 bp, Homo sapiens
atcattcctgagctg

SEQ ID NO: 48910 - DNA, 15 bp, Homo sapiens
tcattcctgagctgt

SEQ ID NO: 48911 - DNA, 15 bp, Homo sapiens
cattcctgagctgtg

SEQ ID NO: 48912 - DNA, 15 bp, Homo sapiens
attcctgagctgtgt

SEQ ID NO: 48913 - DNA, 15 bp, Homo sapiens
ttcctgagctgtgtg

SEQ ID NO: 48914 - DNA, 15 bp, Homo sapiens
tcctgagctgtgtgg

SEQ ID NO: 48915 - DNA, 15 bp, Homo sapiens
cctgagctgtgtggc

SEQ ID NO: 48916 - DNA, 15 bp, Homo sapiens
ctgagctgtgtggca

SEQ ID NO: 48917 - DNA, 15 bp, Homo sapiens
tgagctgtgtggcag

SEQ ID NO: 48918 - DNA, 15 bp, Homo sapiens
gagctgtgtggcagc

SEQ ID NO: 48919 - DNA, 15 bp, Homo sapiens
agctgtgtggcagca

SEQ ID NO: 48920 - DNA, 15 bp, Homo sapiens
gctgtgtggcagcag

SEQ ID NO: 48921 - DNA, 15 bp, Homo sapiens
ctgtgtggcagcagc

SEQ ID NO: 48922 - DNA, 15 bp, Homo sapiens
tgtgtggcagcagca

SEQ ID NO: 48923 - DNA, 15 bp, Homo sapiens
gtgtggcagcagcag

SEQ ID NO: 48924 - DNA, 15 bp, Homo sapiens
tgtggcagcagcagc

SEQ ID NO: 48925 - DNA, 15 bp, Homo sapiens
gtggcagcagcagca

SEQ ID NO: 48926 - DNA, 15 bp, Homo sapiens
tggcagcagcagcag

SEQ ID NO: 48927 - DNA, 15 bp, Homo sapiens
ggcagcagcagcagc

SEQ ID NO: 48928 - DNA, 15 bp, Homo sapiens
gcagcagcagcagct

SEQ ID NO: 48929 - DNA, 15 bp, Homo sapiens
cagcagcagcagctg

SEQ ID NO: 48930 - DNA, 15 bp, Homo sapiens
agcagcagcagctgc

SEQ ID NO: 48931 - DNA, 15 bp, Homo sapiens
gcagcagcagctgct

SEQ ID NO: 48932 - DNA, 15 bp, Homo sapiens
cagcagcagctgctc

SEQ ID NO: 48933 - DNA, 15 bp, Homo sapiens
agcagcagctgctcc

SEQ ID NO: 48934 - DNA, 15 bp, Homo sapiens
gcagcagctgctcct

SEQ ID NO: 48935 - DNA, 15 bp, Homo sapiens
cagcagctgctcctt

SEQ ID NO: 48936 - DNA, 15 bp, Homo sapiens
agcagctgctccttt

SEQ ID NO: 48937 - DNA, 15 bp, Homo sapiens
gcagctgctcctttt

SEQ ID NO: 48938 - DNA, 15 bp, Homo sapiens
cagctgctcctttta

SEQ ID NO: 48939 - DNA, 15 bp, Homo sapiens
agctgctccttttat

SEQ ID NO: 48940 - DNA, 15 bp, Homo sapiens
gctgctccttttata

SEQ ID NO: 48941 - DNA, 15 bp, Homo sapiens
ctgctccttttatat

SEQ ID NO: 48942 - DNA, 15 bp, Homo sapiens
tgctccttttatatg

SEQ ID NO: 48943 - DNA, 15 bp, Homo sapiens
gctccttttatatgg

SEQ ID NO: 48944 - DNA, 15 bp, Homo sapiens
ctccttttatatggc

SEQ ID NO: 48945 - DNA, 15 bp, Homo sapiens
tccttttatatggca

SEQ ID NO: 48946 - DNA, 15 bp, Homo sapiens
ccttttatatggcag

SEQ ID NO: 48947 - DNA, 15 bp, Homo sapiens
cttttatatggcaga

SEQ ID NO: 48948 - DNA, 15 bp, Homo sapiens
ttttatatggcagac

SEQ ID NO: 48949 - DNA, 15 bp, Homo sapiens
tttatatggcagaca

SEQ ID NO: 48950 - DNA, 15 bp, Homo sapiens
ttatatggcagacag

SEQ ID NO: 48951 - DNA, 15 bp, Homo sapiens
tatatggcagacagg

SEQ ID NO: 48952 - DNA, 15 bp, Homo sapiens
atatggcagacaggg

SEQ ID NO: 48953 - DNA, 15 bp, Homo sapiens
tatggcagacagggt

SEQ ID NO: 48954 - DNA, 15 bp, Homo sapiens
atggcagacagggtg

SEQ ID NO: 48955 - DNA, 15 bp, Homo sapiens
tggcagacagggtga

SEQ ID NO: 48956 - DNA, 15 bp, Homo sapiens
ggcagacagggtgat

SEQ ID NO: 48957 - DNA, 15 bp, Homo sapiens
gcagacagggtgatt

SEQ ID NO: 48958 - DNA, 15 bp, Homo sapiens
cagacagggtgattg

SEQ ID NO: 48959 - DNA, 15 bp, Homo sapiens
agacagggtgattgc

SEQ ID NO: 48960 - DNA, 15 bp, Homo sapiens
gacagggtgattgct

SEQ ID NO: 48961 - DNA, 15 bp, Homo sapiens
acagggtgattgctt

SEQ ID NO: 48962 - DNA, 15 bp, Homo sapiens
cagggtgattgcttg

SEQ ID NO: 48963 - DNA, 15 bp, Homo sapiens
agggtgattgcttgt

SEQ ID NO: 48964 - DNA, 15 bp, Homo sapiens
gggtgattgcttgtt

SEQ ID NO: 48965 - DNA, 15 bp, Homo sapiens
ggtgattgcttgttg

SEQ ID NO: 48966 - DNA, 15 bp, Homo sapiens
gtgattgcttgttgg

SEQ ID NO: 48967 - DNA, 15 bp, Homo sapiens
tgattgcttgttggg

SEQ ID NO: 48968 - DNA, 15 bp, Homo sapiens
gattgcttgttgggc

SEQ ID NO: 48969 - DNA, 15 bp, Homo sapiens
attgcttgttgggca

SEQ ID NO: 48970 - DNA, 15 bp, Homo sapiens
ttgcttgttgggcaa

SEQ ID NO: 48971 - DNA, 15 bp, Homo sapiens
tgcttgttgggcaag

SEQ ID NO: 48972 - DNA, 15 bp, Homo sapiens
gcttgttgggcaaga

SEQ ID NO: 48973 - DNA, 15 bp, Homo sapiens
cttgttgggcaagag

SEQ ID NO: 48974 - DNA, 15 bp, Homo sapiens
ttgttgggcaagagc

SEQ ID NO: 48975 - DNA, 15 bp, Homo sapiens
tgttgggcaagagcc

SEQ ID NO: 48976 - DNA, 15 bp, Homo sapiens
gttgggcaagagccc

SEQ ID NO: 48977 - DNA, 15 bp, Homo sapiens
ttgggcaagagccct

SEQ ID NO: 48978 - DNA, 15 bp, Homo sapiens
tgggcaagagccctc

SEQ ID NO: 48979 - DNA, 15 bp, Homo sapiens
gggcaagagccctcc

SEQ ID NO: 48980 - DNA, 15 bp, Homo sapiens
ggcaagagccctcct

SEQ ID NO: 48981 - DNA, 15 bp, Homo sapiens
gcaagagccctccta

SEQ ID NO: 48982 - DNA, 15 bp, Homo sapiens
caagagccctcctac

SEQ ID NO: 48983 - DNA, 15 bp, Homo sapiens
aagagccctcctaca

SEQ ID NO: 48984 - DNA, 15 bp, Homo sapiens
agagccctcctacac

SEQ ID NO: 48985 - DNA, 15 bp, Homo sapiens
gagccctcctacact

SEQ ID NO: 48986 - DNA, 15 bp, Homo sapiens
agccctcctacacta

SEQ ID NO: 48987 - DNA, 15 bp, Homo sapiens
gccctcctacactat

SEQ ID NO: 48988 - DNA, 15 bp, Homo sapiens
ccctcctacactatc

SEQ ID NO: 48989 - DNA, 15 bp, Homo sapiens
cctcctacactatct

SEQ ID NO: 48990 - DNA, 15 bp, Homo sapiens
ctcctacactatctt

SEQ ID NO: 48991 - DNA, 15 bp, Homo sapiens
tcctacactatctta

SEQ ID NO: 48992 - DNA, 15 bp, Homo sapiens
cctacactatcttag

SEQ ID NO: 48993 - DNA, 15 bp, Homo sapiens
ctacactatcttaga

SEQ ID NO: 48994 - DNA, 15 bp, Homo sapiens
tacactatcttagag

SEQ ID NO: 48995 - DNA, 15 bp, Homo sapiens
acactatcttagagt

SEQ ID NO: 48996 - DNA, 15 bp, Homo sapiens
cactatcttagagtg

SEQ ID NO: 48997 - DNA, 15 bp, Homo sapiens
actatcttagagtga

SEQ ID NO: 48998 - DNA, 15 bp, Homo sapiens
ctatcttagagtgaa

SEQ ID NO: 48999 - DNA, 15 bp, Homo sapiens
tatcttagagtgaat

SEQ ID NO: 49000 - DNA, 15 bp, Homo sapiens
atcttagagtgaata

SEQ ID NO: 49001 - DNA, 15 bp, Homo sapiens
tcttagagtgaatac

SEQ ID NO: 49002 - DNA, 15 bp, Homo sapiens
cttagagtgaatacc

SEQ ID NO: 49003 - DNA, 15 bp, Homo sapiens
ttagagtgaataccc

SEQ ID NO: 49004 - DNA, 15 bp, Homo sapiens
tagagtgaataccct

SEQ ID NO: 49005 - DNA, 15 bp, Homo sapiens
agagtgaataccctc

SEQ ID NO: 49006 - DNA, 15 bp, Homo sapiens
gagtgaataccctct

SEQ ID NO: 49007 - DNA, 15 bp, Homo sapiens
agtgaataccctcta

SEQ ID NO: 49008 - DNA, 15 bp, Homo sapiens
gtgaataccctctat

SEQ ID NO: 49009 - DNA, 15 bp, Homo sapiens
tgaataccctctatc

SEQ ID NO: 49010 - DNA, 15 bp, Homo sapiens
gaataccctctatct

SEQ ID NO: 49011 - DNA, 15 bp, Homo sapiens
aataccctctatctg

SEQ ID NO: 49012 - DNA, 15 bp, Homo sapiens
ataccctctatctgc

SEQ ID NO: 49013 - DNA, 15 bp, Homo sapiens
taccctctatctgca

SEQ ID NO: 49014 - DNA, 15 bp, Homo sapiens
accctctatctgcag

SEQ ID NO: 49015 - DNA, 15 bp, Homo sapiens
ccctctatctgcagt

SEQ ID NO: 49016 - DNA, 15 bp, Homo sapiens
cctctatctgcagtc

SEQ ID NO: 49017 - DNA, 15 bp, Homo sapiens
ctctatctgcagtcc

SEQ ID NO: 49018 - DNA, 15 bp, Homo sapiens
tctatctgcagtcca

SEQ ID NO: 49019 - DNA, 15 bp, Homo sapiens
ctatctgcagtccag

SEQ ID NO: 49020 - DNA, 15 bp, Homo sapiens
tatctgcagtccagg

SEQ ID NO: 49021 - DNA, 15 bp, Homo sapiens
atctgcagtccaggg

SEQ ID NO: 49022 - DNA, 15 bp, Homo sapiens
tctgcagtccagggt

SEQ ID NO: 49023 - DNA, 15 bp, Homo sapiens
ctgcagtccagggtc

SEQ ID NO: 49024 - DNA, 15 bp, Homo sapiens
tgcagtccagggtct

SEQ ID NO: 49025 - DNA, 15 bp, Homo sapiens
gcagtccagggtctg

SEQ ID NO: 49026 - DNA, 15 bp, Homo sapiens
cagtccagggtctgc

SEQ ID NO: 49027 - DNA, 15 bp, Homo sapiens
agtccagggtctgca

SEQ ID NO: 49028 - DNA, 15 bp, Homo sapiens
gtccagggtctgcac

SEQ ID NO: 49029 - DNA, 15 bp, Homo sapiens
tccagggtctgcaca

SEQ ID NO: 49030 - DNA, 15 bp, Homo sapiens
ccagggtctgcacag

SEQ ID NO: 49031 - DNA, 15 bp, Homo sapiens
cagggtctgcacagc

SEQ ID NO: 49032 - DNA, 15 bp, Homo sapiens
agggtctgcacagcc

SEQ ID NO: 49033 - DNA, 15 bp, Homo sapiens
gggtctgcacagcca

SEQ ID NO: 49034 - DNA, 15 bp, Homo sapiens
ggtctgcacagccac

SEQ ID NO: 49035 - DNA, 15 bp, Homo sapiens
gtctgcacagccaca

SEQ ID NO: 49036 - DNA, 15 bp, Homo sapiens
tctgcacagccacat

SEQ ID NO: 49037 - DNA, 15 bp, Homo sapiens
ctgcacagccacatg

SEQ ID NO: 49038 - DNA, 15 bp, Homo sapiens
tgcacagccacatgg

SEQ ID NO: 49039 - DNA, 15 bp, Homo sapiens
gcacagccacatggt

SEQ ID NO: 49040 - DNA, 15 bp, Homo sapiens
cacagccacatggtc

SEQ ID NO: 49041 - DNA, 15 bp, Homo sapiens
acagccacatggtcc

SEQ ID NO: 49042 - DNA, 15 bp, Homo sapiens
cagccacatggtcct

SEQ ID NO: 49043 - DNA, 15 bp, Homo sapiens
agccacatggtcctc

SEQ ID NO: 49044 - DNA, 15 bp, Homo sapiens
gccacatggtcctct

SEQ ID NO: 49045 - DNA, 15 bp, Homo sapiens
ccacatggtcctcta

SEQ ID NO: 49046 - DNA, 15 bp, Homo sapiens
cacatggtcctctaa

SEQ ID NO: 49047 - DNA, 15 bp, Homo sapiens
acatggtcctctaat

SEQ ID NO: 49048 - DNA, 15 bp, Homo sapiens
catggtcctctaata

SEQ ID NO: 49049 - DNA, 15 bp, Homo sapiens
atggtcctctaatag

SEQ ID NO: 49050 - DNA, 15 bp, Homo sapiens
tggtcctctaatagg

SEQ ID NO: 49051 - DNA, 15 bp, Homo sapiens
ggtcctctaataggt

SEQ ID NO: 49052 - DNA, 15 bp, Homo sapiens
gtcctctaataggtc

SEQ ID NO: 49053 - DNA, 15 bp, Homo sapiens
tcctctaataggtcc

SEQ ID NO: 49054 - DNA, 15 bp, Homo sapiens
cctctaataggtcca

SEQ ID NO: 49055 - DNA, 15 bp, Homo sapiens
ctctaataggtccac

SEQ ID NO: 49056 - DNA, 15 bp, Homo sapiens
tctaataggtccacc

SEQ ID NO: 49057 - DNA, 15 bp, Homo sapiens
ctaataggtccacca

SEQ ID NO: 49058 - DNA, 15 bp, Homo sapiens
taataggtccaccag

SEQ ID NO: 49059 - DNA, 15 bp, Homo sapiens
aataggtccaccaga

SEQ ID NO: 49060 - DNA, 15 bp, Homo sapiens
ataggtccaccagac

SEQ ID NO: 49061 - DNA, 15 bp, Homo sapiens
taggtccaccagacc

SEQ ID NO: 49062 - DNA, 15 bp, Homo sapiens
aggtccaccagacca

SEQ ID NO: 49063 - DNA, 15 bp, Homo sapiens
ggtccaccagaccat

SEQ ID NO: 49064 - DNA, 15 bp, Homo sapiens
gtccaccagaccatt

SEQ ID NO: 49065 - DNA, 15 bp, Homo sapiens
tccaccagaccattt

SEQ ID NO: 49066 - DNA, 15 bp, Homo sapiens
ccaccagaccatttg

SEQ ID NO: 49067 - DNA, 15 bp, Homo sapiens
caccagaccatttgc

SEQ ID NO: 49068 - DNA, 15 bp, Homo sapiens
accagaccatttgcc

SEQ ID NO: 49069 - DNA, 15 bp, Homo sapiens
ccagaccatttgcct

SEQ ID NO: 49070 - DNA, 15 bp, Homo sapiens
cagaccatttgcctg

SEQ ID NO: 49071 - DNA, 15 bp, Homo sapiens
agaccatttgcctgc

SEQ ID NO: 49072 - DNA, 15 bp, Homo sapiens
gaccatttgcctgca

SEQ ID NO: 49073 - DNA, 15 bp, Homo sapiens
accatttgcctgcaa

SEQ ID NO: 49074 - DNA, 15 bp, Homo sapiens
ccatttgcctgcaaa

SEQ ID NO: 49075 - DNA, 15 bp, Homo sapiens
catttgcctgcaaac

SEQ ID NO: 49076 - DNA, 15 bp, Homo sapiens
atttgcctgcaaaca

SEQ ID NO: 49077 - DNA, 15 bp, Homo sapiens
tttgcctgcaaacag

SEQ ID NO: 49078 - DNA, 15 bp, Homo sapiens
ttgcctgcaaacagc

SEQ ID NO: 49079 - DNA, 15 bp, Homo sapiens
tgcctgcaaacagcc

SEQ ID NO: 49080 - DNA, 15 bp, Homo sapiens
gcctgcaaacagcct

SEQ ID NO: 49081 - DNA, 15 bp, Homo sapiens
cctgcaaacagcctc

SEQ ID NO: 49082 - DNA, 15 bp, Homo sapiens
ctgcaaacagcctca

SEQ ID NO: 49083 - DNA, 15 bp, Homo sapiens
tgcaaacagcctcat

SEQ ID NO: 49084 - DNA, 15 bp, Homo sapiens
gcaaacagcctcatc

SEQ ID NO: 49085 - DNA, 15 bp, Homo sapiens
caaacagcctcatcc

SEQ ID NO: 49086 - DNA, 15 bp, Homo sapiens
aaacagcctcatcct

SEQ ID NO: 49087 - DNA, 15 bp, Homo sapiens
aacagcctcatcctc

SEQ ID NO: 49088 - DNA, 15 bp, Homo sapiens
acagcctcatcctca

SEQ ID NO: 49089 - DNA, 15 bp, Homo sapiens
cagcctcatcctcag

SEQ ID NO: 49090 - DNA, 15 bp, Homo sapiens
agcctcatcctcagt

SEQ ID NO: 49091 - DNA, 15 bp, Homo sapiens
gcctcatcctcagtg

SEQ ID NO: 49092 - DNA, 15 bp, Homo sapiens
cctcatcctcagtgc

SEQ ID NO: 49093 - DNA, 15 bp, Homo sapiens
ctcatcctcagtgcc

SEQ ID NO: 49094 - DNA, 15 bp, Homo sapiens
tcatcctcagtgccc

SEQ ID NO: 49095 - DNA, 15 bp, Homo sapiens
catcctcagtgccca

SEQ ID NO: 49096 - DNA, 15 bp, Homo sapiens
atcctcagtgcccac

SEQ ID NO: 49097 - DNA, 15 bp, Homo sapiens
tcctcagtgcccact

SEQ ID NO: 49098 - DNA, 15 bp, Homo sapiens
cctcagtgcccactg

SEQ ID NO: 49099 - DNA, 15 bp, Homo sapiens
ctcagtgcccactgt

SEQ ID NO: 49100 - DNA, 15 bp, Homo sapiens
tcagtgcccactgtc

SEQ ID NO: 49101 - DNA, 15 bp, Homo sapiens
cagtgcccactgtct

SEQ ID NO: 49102 - DNA, 15 bp, Homo sapiens
agtgcccactgtctc

SEQ ID NO: 49103 - DNA, 15 bp, Homo sapiens
gtgcccactgtctcc

SEQ ID NO: 49104 - DNA, 15 bp, Homo sapiens
tgcccactgtctcct

SEQ ID NO: 49105 - DNA, 15 bp, Homo sapiens
gcccactgtctccta

SEQ ID NO: 49106 - DNA, 15 bp, Homo sapiens
cccactgtctcctag

SEQ ID NO: 49107 - DNA, 15 bp, Homo sapiens
ccactgtctcctagc

SEQ ID NO: 49108 - DNA, 15 bp, Homo sapiens
cactgtctcctagct

SEQ ID NO: 49109 - DNA, 15 bp, Homo sapiens
actgtctcctagctg

SEQ ID NO: 49110 - DNA, 15 bp, Homo sapiens
ctgtctcctagctgt

SEQ ID NO: 49111 - DNA, 15 bp, Homo sapiens
tgtctcctagctgtg

SEQ ID NO: 49112 - DNA, 15 bp, Homo sapiens
gtctcctagctgtgg

SEQ ID NO: 49113 - DNA, 15 bp, Homo sapiens
tctcctagctgtgga

SEQ ID NO: 49114 - DNA, 15 bp, Homo sapiens
ctcctagctgtggag

SEQ ID NO: 49115 - DNA, 15 bp, Homo sapiens
tcctagctgtggagc

SEQ ID NO: 49116 - DNA, 15 bp, Homo sapiens
cctagctgtggagct

SEQ ID NO: 49117 - DNA, 15 bp, Homo sapiens
ctagctgtggagctt

SEQ ID NO: 49118 - DNA, 15 bp, Homo sapiens
tagctgtggagcttg

SEQ ID NO: 49119 - DNA, 15 bp, Homo sapiens
agctgtggagcttgg

SEQ ID NO: 49120 - DNA, 15 bp, Homo sapiens
gctgtggagcttgga

SEQ ID NO: 49121 - DNA, 15 bp, Homo sapiens
ctgtggagcttggat

SEQ ID NO: 49122 - DNA, 15 bp, Homo sapiens
tgtggagcttggatt

SEQ ID NO: 49123 - DNA, 15 bp, Homo sapiens
gtggagcttggattc

SEQ ID NO: 49124 - DNA, 15 bp, Homo sapiens
tggagcttggattcc

SEQ ID NO: 49125 - DNA, 15 bp, Homo sapiens
ggagcttggattcct

SEQ ID NO: 49126 - DNA, 15 bp, Homo sapiens
gagcttggattccta

SEQ ID NO: 49127 - DNA, 15 bp, Homo sapiens
agcttggattcctat

SEQ ID NO: 49128 - DNA, 15 bp, Homo sapiens
gcttggattcctatg

SEQ ID NO: 49129 - DNA, 15 bp, Homo sapiens
cttggattcctatgg

SEQ ID NO: 49130 - DNA, 15 bp, Homo sapiens
ttggattcctatgga

SEQ ID NO: 49131 - DNA, 15 bp, Homo sapiens
tggattcctatggaa

SEQ ID NO: 49132 - DNA, 15 bp, Homo sapiens
ggattcctatggaat

SEQ ID NO: 49133 - DNA, 15 bp, Homo sapiens
gattcctatggaatt

SEQ ID NO: 49134 - DNA, 15 bp, Homo sapiens
attcctatggaattg

SEQ ID NO: 49135 - DNA, 15 bp, Homo sapiens
ttcctatggaattgg

SEQ ID NO: 49136 - DNA, 15 bp, Homo sapiens
tcctatggaattggg

SEQ ID NO: 49137 - DNA, 15 bp, Homo sapiens
cctatggaattgggt

SEQ ID NO: 49138 - DNA, 15 bp, Homo sapiens
ctatggaattgggtt

SEQ ID NO: 49139 - DNA, 15 bp, Homo sapiens
tatggaattgggttc

SEQ ID NO: 49140 - DNA, 15 bp, Homo sapiens
atggaattgggttct

SEQ ID NO: 49141 - DNA, 15 bp, Homo sapiens
tggaattgggttctg

SEQ ID NO: 49142 - DNA, 15 bp, Homo sapiens
ggaattgggttctgc

SEQ ID NO: 49143 - DNA, 15 bp, Homo sapiens
gaattgggttctgct

SEQ ID NO: 49144 - DNA, 15 bp, Homo sapiens
aattgggttctgctg

SEQ ID NO: 49145 - DNA, 15 bp, Homo sapiens
attgggttctgctga

SEQ ID NO: 49146 - DNA, 15 bp, Homo sapiens
ttgggttctgctgaa

SEQ ID NO: 49147 - DNA, 15 bp, Homo sapiens
tgggttctgctgaac

SEQ ID NO: 49148 - DNA, 15 bp, Homo sapiens
gaatctagcgtagca

SEQ ID NO: 49149 - DNA, 15 bp, Homo sapiens
aatctagcgtagcac

SEQ ID NO: 49150 - DNA, 15 bp, Homo sapiens
atctagcgtagcact

SEQ ID NO: 49151 - DNA, 15 bp, Homo sapiens
tctagcgtagcactc

SEQ ID NO: 49152 - DNA, 15 bp, Homo sapiens
ctagcgtagcactca

SEQ ID NO: 49153 - DNA, 15 bp, Homo sapiens
tagcgtagcactcat

SEQ ID NO: 49154 - DNA, 15 bp, Homo sapiens
agcgtagcactcata

SEQ ID NO: 49155 - DNA, 15 bp, Homo sapiens
gcgtagcactcatac

SEQ ID NO: 49156 - DNA, 15 bp, Homo sapiens
cgtagcactcatacc

SEQ ID NO: 49157 - DNA, 15 bp, Homo sapiens
gtagcactcataccc

SEQ ID NO: 49158 - DNA, 15 bp, Homo sapiens
tagcactcataccca

SEQ ID NO: 49159 - DNA, 15 bp, Homo sapiens
agcactcatacccat

SEQ ID NO: 49160 - DNA, 15 bp, Homo sapiens
gcactcatacccatt

SEQ ID NO: 49161 - DNA, 15 bp, Homo sapiens
cactcatacccattc

SEQ ID NO: 49162 - DNA, 15 bp, Homo sapiens
actcatacccattcc

SEQ ID NO: 49163 - DNA, 15 bp, Homo sapiens
ctcatacccattcct

SEQ ID NO: 49164 - DNA, 15 bp, Homo sapiens
tcatacccattcctt

SEQ ID NO: 49165 - DNA, 15 bp, Homo sapiens
catacccattccttt

SEQ ID NO: 49166 - DNA, 15 bp, Homo sapiens
atacccattcctttg

SEQ ID NO: 49167 - DNA, 15 bp, Homo sapiens
tacccattcctttgc

SEQ ID NO: 49168 - DNA, 15 bp, Homo sapiens
acccattcctttgct

SEQ ID NO: 49169 - DNA, 15 bp, Homo sapiens
cccattcctttgctg

SEQ ID NO: 49170 - DNA, 15 bp, Homo sapiens
ccattcctttgctgc

SEQ ID NO: 49171 - DNA, 15 bp, Homo sapiens
cattcctttgctgcc

SEQ ID NO: 49172 - DNA, 15 bp, Homo sapiens
attcctttgctgcct

SEQ ID NO: 49173 - DNA, 15 bp, Homo sapiens
ttcctttgctgcctg

SEQ ID NO: 49174 - DNA, 15 bp, Homo sapiens
tcctttgctgcctga

SEQ ID NO: 49175 - DNA, 15 bp, Homo sapiens
cctttgctgcctgag

SEQ ID NO: 49176 - DNA, 15 bp, Homo sapiens
ctttgctgcctgaga

SEQ ID NO: 49177 - DNA, 15 bp, Homo sapiens
tttgctgcctgagac

SEQ ID NO: 49178 - DNA, 15 bp, Homo sapiens
ttgctgcctgagacg

SEQ ID NO: 49179 - DNA, 15 bp, Homo sapiens
tgctgcctgagacgg

SEQ ID NO: 49180 - DNA, 15 bp, Homo sapiens
gctgcctgagacggt

SEQ ID NO: 49181 - DNA, 15 bp, Homo sapiens
ctgcctgagacggtt

SEQ ID NO: 49182 - DNA, 15 bp, Homo sapiens
tgcctgagacggttc

SEQ ID NO: 49183 - DNA, 15 bp, Homo sapiens
gcctgagacggttca

SEQ ID NO: 49184 - DNA, 15 bp, Homo sapiens
cctgagacggttcag

SEQ ID NO: 49185 - DNA, 15 bp, Homo sapiens
ctgagacggttcagt

SEQ ID NO: 49186 - DNA, 15 bp, Homo sapiens
tgagacggttcagtg

SEQ ID NO: 49187 - DNA, 15 bp, Homo sapiens
gagacggttcagtgg

SEQ ID NO: 49188 - DNA, 15 bp, Homo sapiens
agacggttcagtggc

SEQ ID NO: 49189 - DNA, 15 bp, Homo sapiens
gacggttcagtggct

SEQ ID NO: 49190 - DNA, 15 bp, Homo sapiens
acggttcagtggctg

SEQ ID NO: 49191 - DNA, 15 bp, Homo sapiens
cggttcagtggctgg

SEQ ID NO: 49192 - DNA, 15 bp, Homo sapiens
ggttcagtggctggc

SEQ ID NO: 49193 - DNA, 15 bp, Homo sapiens
gttcagtggctggca

SEQ ID NO: 49194 - DNA, 15 bp, Homo sapiens
ttcagtggctggcag

SEQ ID NO: 49195 - DNA, 15 bp, Homo sapiens
tcagtggctggcagg

SEQ ID NO: 49196 - DNA, 15 bp, Homo sapiens
cagtggctggcaggc

SEQ ID NO: 49197 - DNA, 15 bp, Homo sapiens
agtggctggcaggcc

SEQ ID NO: 49198 - DNA, 15 bp, Homo sapiens
gtggctggcaggcca

SEQ ID NO: 49199 - DNA, 15 bp, Homo sapiens
tggctggcaggccag

SEQ ID NO: 49200 - DNA, 15 bp, Homo sapiens
ggctggcaggccagc

SEQ ID NO: 49201 - DNA, 15 bp, Homo sapiens
gctggcaggccagca

SEQ ID NO: 49202 - DNA, 15 bp, Homo sapiens
ctggcaggccagcag

SEQ ID NO: 49203 - DNA, 15 bp, Homo sapiens
tggcaggccagcagg

SEQ ID NO: 49204 - DNA, 15 bp, Homo sapiens
ggcaggccagcagga

SEQ ID NO: 49205 - DNA, 15 bp, Homo sapiens
gcaggccagcaggat

SEQ ID NO: 49206 - DNA, 15 bp, Homo sapiens
caggccagcaggatc

SEQ ID NO: 49207 - DNA, 15 bp, Homo sapiens
aggccagcaggatcg

SEQ ID NO: 49208 - DNA, 15 bp, Homo sapiens
ggccagcaggatcgc

SEQ ID NO: 49209 - DNA, 15 bp, Homo sapiens
gccagcaggatcgct

SEQ ID NO: 49210 - DNA, 15 bp, Homo sapiens
ccagcaggatcgctg

SEQ ID NO: 49211 - DNA, 15 bp, Homo sapiens
cagcaggatcgctgc

SEQ ID NO: 49212 - DNA, 15 bp, Homo sapiens
agcaggatcgctgca

SEQ ID NO: 49213 - DNA, 15 bp, Homo sapiens
gcaggatcgctgcag

SEQ ID NO: 49214 - DNA, 15 bp, Homo sapiens
caggatcgctgcagg

SEQ ID NO: 49215 - DNA, 15 bp, Homo sapiens
aggatcgctgcaggg

SEQ ID NO: 49216 - DNA, 15 bp, Homo sapiens
ggatcgctgcagggc

SEQ ID NO: 49217 - DNA, 15 bp, Homo sapiens
gatcgctgcagggcc

SEQ ID NO: 49218 - DNA, 15 bp, Homo sapiens
atcgctgcagggccc

SEQ ID NO: 49219 - DNA, 15 bp, Homo sapiens
tcgctgcagggccct

SEQ ID NO: 49220 - DNA, 15 bp, Homo sapiens
cgctgcagggccctg

SEQ ID NO: 49221 - DNA, 15 bp, Homo sapiens
gctgcagggccctga

SEQ ID NO: 49222 - DNA, 15 bp, Homo sapiens
ctgcagggccctgag

SEQ ID NO: 49223 - DNA, 15 bp, Homo sapiens
tgcagggccctgagc

SEQ ID NO: 49224 - DNA, 15 bp, Homo sapiens
gcagggccctgagcc

SEQ ID NO: 49225 - DNA, 15 bp, Homo sapiens
cagggccctgagccc

SEQ ID NO: 49226 - DNA, 15 bp, Homo sapiens
agggccctgagcccc

SEQ ID NO: 49227 - DNA, 15 bp, Homo sapiens
gggccctgagcccca

SEQ ID NO: 49228 - DNA, 15 bp, Homo sapiens
ggccctgagccccat

SEQ ID NO: 49229 - DNA, 15 bp, Homo sapiens
gccctgagccccatc

SEQ ID NO: 49230 - DNA, 15 bp, Homo sapiens
ccctgagccccatct

SEQ ID NO: 49231 - DNA, 15 bp, Homo sapiens
cctgagccccatcta

SEQ ID NO: 49232 - DNA, 15 bp, Homo sapiens
ctgagccccatctag

SEQ ID NO: 49233 - DNA, 15 bp, Homo sapiens
tgagccccatctagt

SEQ ID NO: 49234 - DNA, 15 bp, Homo sapiens
gagccccatctagtc

SEQ ID NO: 49235 - DNA, 15 bp, Homo sapiens
agccccatctagtca

SEQ ID NO: 49236 - DNA, 15 bp, Homo sapiens
gccccatctagtcag

SEQ ID NO: 49237 - DNA, 15 bp, Homo sapiens
ccccatctagtcagt

SEQ ID NO: 49238 - DNA, 15 bp, Homo sapiens
cccatctagtcagtt

SEQ ID NO: 49239 - DNA, 15 bp, Homo sapiens
ccatctagtcagttc

SEQ ID NO: 49240 - DNA, 15 bp, Homo sapiens
catctagtcagttca

SEQ ID NO: 49241 - DNA, 15 bp, Homo sapiens
atctagtcagttcat

SEQ ID NO: 49242 - DNA, 15 bp, Homo sapiens
tctagtcagttcatc

SEQ ID NO: 49243 - DNA, 15 bp, Homo sapiens
ctagtcagttcatca

SEQ ID NO: 49244 - DNA, 15 bp, Homo sapiens
tagtcagttcatcag

SEQ ID NO: 49245 - DNA, 15 bp, Homo sapiens
agtcagttcatcagc

SEQ ID NO: 49246 - DNA, 15 bp, Homo sapiens
gtcagttcatcagcc

SEQ ID NO: 49247 - DNA, 15 bp, Homo sapiens
tcagttcatcagcct

SEQ ID NO: 49248 - DNA, 15 bp, Homo sapiens
cagttcatcagcctt

SEQ ID NO: 49249 - DNA, 15 bp, Homo sapiens
agttcatcagccttc

SEQ ID NO: 49250 - DNA, 15 bp, Homo sapiens
gttcatcagccttca

SEQ ID NO: 49251 - DNA, 15 bp, Homo sapiens
ttcatcagccttcag

SEQ ID NO: 49252 - DNA, 15 bp, Homo sapiens
tcatcagccttcagt

SEQ ID NO: 49253 - DNA, 15 bp, Homo sapiens
catcagccttcagtc

SEQ ID NO: 49254 - DNA, 15 bp, Homo sapiens
atcagccttcagtcc

SEQ ID NO: 49255 - DNA, 15 bp, Homo sapiens
tcagccttcagtcct

SEQ ID NO: 49256 - DNA, 15 bp, Homo sapiens
cagccttcagtcctc

SEQ ID NO: 49257 - DNA, 15 bp, Homo sapiens
agccttcagtcctcc

SEQ ID NO: 49258 - DNA, 15 bp, Homo sapiens
gccttcagtcctccc

SEQ ID NO: 49259 - DNA, 15 bp, Homo sapiens
ccttcagtcctcccg

SEQ ID NO: 49260 - DNA, 15 bp, Homo sapiens
cttcagtcctcccgt

SEQ ID NO: 49261 - DNA, 15 bp, Homo sapiens
ttcagtcctcccgta

SEQ ID NO: 49262 - DNA, 15 bp, Homo sapiens
tcagtcctcccgtag

SEQ ID NO: 49263 - DNA, 15 bp, Homo sapiens
cagtcctcccgtagc

SEQ ID NO: 49264 - DNA, 15 bp, Homo sapiens
agtcctcccgtagct

SEQ ID NO: 49265 - DNA, 15 bp, Homo sapiens
gtcctcccgtagctt

SEQ ID NO: 49266 - DNA, 15 bp, Homo sapiens
tcctcccgtagcttc

SEQ ID NO: 49267 - DNA, 15 bp, Homo sapiens
cctcccgtagcttcc

SEQ ID NO: 49268 - DNA, 15 bp, Homo sapiens
ctcccgtagcttcct

SEQ ID NO: 49269 - DNA, 15 bp, Homo sapiens
tcccgtagcttccta

SEQ ID NO: 49270 - DNA, 15 bp, Homo sapiens
cccgtagcttcctag

SEQ ID NO: 49271 - DNA, 15 bp, Homo sapiens
ccgtagcttcctagg

SEQ ID NO: 49272 - DNA, 15 bp, Homo sapiens
cgtagcttcctaggt

SEQ ID NO: 49273 - DNA, 15 bp, Homo sapiens
gtagcttcctaggtt

SEQ ID NO: 49274 - DNA, 15 bp, Homo sapiens
tagcttcctaggtta

SEQ ID NO: 49275 - DNA, 15 bp, Homo sapiens
agcttcctaggttag

SEQ ID NO: 49276 - DNA, 15 bp, Homo sapiens
gcttcctaggttaga

SEQ ID NO: 49277 - DNA, 15 bp, Homo sapiens
cttcctaggttagat

SEQ ID NO: 49278 - DNA, 15 bp, Homo sapiens
ttcctaggttagatg

SEQ ID NO: 49279 - DNA, 15 bp, Homo sapiens
tcctaggttagatgc

SEQ ID NO: 49280 - DNA, 15 bp, Homo sapiens
cctaggttagatgct

SEQ ID NO: 49281 - DNA, 15 bp, Homo sapiens
ctaggttagatgctg

SEQ ID NO: 49282 - DNA, 15 bp, Homo sapiens
taggttagatgctga

SEQ ID NO: 49283 - DNA, 15 bp, Homo sapiens
aggttagatgctgat

SEQ ID NO: 49284 - DNA, 15 bp, Homo sapiens
ggttagatgctgatg

SEQ ID NO: 49285 - DNA, 15 bp, Homo sapiens
gttagatgctgatgt

SEQ ID NO: 49286 - DNA, 15 bp, Homo sapiens
ttagatgctgatgtt

SEQ ID NO: 49287 - DNA, 15 bp, Homo sapiens
tagatgctgatgttc

SEQ ID NO: 49288 - DNA, 15 bp, Homo sapiens
agatgctgatgttct

SEQ ID NO: 49289 - DNA, 15 bp, Homo sapiens
gatgctgatgttctt

SEQ ID NO: 49290 - DNA, 15 bp, Homo sapiens
atgctgatgttcttg

SEQ ID NO: 49291 - DNA, 15 bp, Homo sapiens
tgctgatgttcttgg

SEQ ID NO: 49292 - DNA, 15 bp, Homo sapiens
gctgatgttcttggg

SEQ ID NO: 49293 - DNA, 15 bp, Homo sapiens
ctgatgttcttgggg

SEQ ID NO: 49294 - DNA, 15 bp, Homo sapiens
tgatgttcttgggga

SEQ ID NO: 49295 - DNA, 15 bp, Homo sapiens
gatgttcttggggat

SEQ ID NO: 49296 - DNA, 15 bp, Homo sapiens
atgttcttggggatt

SEQ ID NO: 49297 - DNA, 15 bp, Homo sapiens
tgttcttggggattt

SEQ ID NO: 49298 - DNA, 15 bp, Homo sapiens
gttcttggggatttc

SEQ ID NO: 49299 - DNA, 15 bp, Homo sapiens
ttcttggggatttct

SEQ ID NO: 49300 - DNA, 15 bp, Homo sapiens
tcttggggatttcta

SEQ ID NO: 49301 - DNA, 15 bp, Homo sapiens
cttggggatttctat

SEQ ID NO: 49302 - DNA, 15 bp, Homo sapiens
ttggggatttctatg

SEQ ID NO: 49303 - DNA, 15 bp, Homo sapiens
tggggatttctatga

SEQ ID NO: 49304 - DNA, 15 bp, Homo sapiens
ggggatttctatgat

SEQ ID NO: 49305 - DNA, 15 bp, Homo sapiens
gggatttctatgatg

SEQ ID NO: 49306 - DNA, 15 bp, Homo sapiens
ggatttctatgatga

SEQ ID NO: 49307 - DNA, 15 bp, Homo sapiens
gatttctatgatgat

SEQ ID NO: 49308 - DNA, 15 bp, Homo sapiens
atttctatgatgatt

SEQ ID NO: 49309 - DNA, 15 bp, Homo sapiens
tttctatgatgattt

SEQ ID NO: 49310 - DNA, 15 bp, Homo sapiens
ttctatgatgatttt

SEQ ID NO: 49311 - DNA, 15 bp, Homo sapiens
tctatgatgattttt

SEQ ID NO: 49312 - DNA, 15 bp, Homo sapiens
ctatgatgattttta

SEQ ID NO: 49313 - DNA, 15 bp, Homo sapiens
tatgatgatttttaa

SEQ ID NO: 49314 - DNA, 15 bp, Homo sapiens
atgatgatttttaaa

SEQ ID NO: 49315 - DNA, 15 bp, Homo sapiens
tgatgatttttaaat

SEQ ID NO: 49316 - DNA, 15 bp, Homo sapiens
gatgatttttaaatg

SEQ ID NO: 49317 - DNA, 15 bp, Homo sapiens
atgatttttaaatgt

SEQ ID NO: 49318 - DNA, 15 bp, Homo sapiens
tgatttttaaatgtg

SEQ ID NO: 49319 - DNA, 15 bp, Homo sapiens
gatttttaaatgtgt

SEQ ID NO: 49320 - DNA, 15 bp, Homo sapiens
atttttaaatgtgtg

SEQ ID NO: 49321 - DNA, 15 bp, Homo sapiens
tttttaaatgtgtgt

SEQ ID NO: 49322 - DNA, 15 bp, Homo sapiens
ttttaaatgtgtgtc

SEQ ID NO: 49323 - DNA, 15 bp, Homo sapiens
tttaaatgtgtgtca

SEQ ID NO: 49324 - DNA, 15 bp, Homo sapiens
ttaaatgtgtgtcag

SEQ ID NO: 49325 - DNA, 15 bp, Homo sapiens
taaatgtgtgtcagt

SEQ ID NO: 49326 - DNA, 15 bp, Homo sapiens
aaatgtgtgtcagtg

SEQ ID NO: 49327 - DNA, 15 bp, Homo sapiens
aatgtgtgtcagtgg

SEQ ID NO: 49328 - DNA, 15 bp, Homo sapiens
atgtgtgtcagtggg

SEQ ID NO: 49329 - DNA, 15 bp, Homo sapiens
tgtgtgtcagtggga

SEQ ID NO: 49330 - DNA, 15 bp, Homo sapiens
gtgtgtcagtgggag

SEQ ID NO: 49331 - DNA, 15 bp, Homo sapiens
tgtgtcagtgggagc

SEQ ID NO: 49332 - DNA, 15 bp, Homo sapiens
gtgtcagtgggagca

SEQ ID NO: 49333 - DNA, 15 bp, Homo sapiens
tgtcagtgggagcaa

SEQ ID NO: 49334 - DNA, 15 bp, Homo sapiens
gtcagtgggagcaaa

SEQ ID NO: 49335 - DNA, 15 bp, Homo sapiens
tcagtgggagcaaat

SEQ ID NO: 49336 - DNA, 15 bp, Homo sapiens
cagtgggagcaaata

SEQ ID NO: 49337 - DNA, 15 bp, Homo sapiens
agtgggagcaaatat

SEQ ID NO: 49338 - DNA, 15 bp, Homo sapiens
gtgggagcaaatata

SEQ ID NO: 49339 - DNA, 15 bp, Homo sapiens
tgggagcaaatataa

SEQ ID NO: 49340 - DNA, 15 bp, Homo sapiens
gggagcaaatataat

SEQ ID NO: 49341 - DNA, 15 bp, Homo sapiens
ggagcaaatataatt

SEQ ID NO: 49342 - DNA, 15 bp, Homo sapiens
gagcaaatataatta

SEQ ID NO: 49343 - DNA, 15 bp, Homo sapiens
agcaaatataattaa

SEQ ID NO: 49344 - DNA, 15 bp, Homo sapiens
gcaaatataattaac

SEQ ID NO: 49345 - DNA, 15 bp, Homo sapiens
caaatataattaact

SEQ ID NO: 49346 - DNA, 15 bp, Homo sapiens
aaatataattaactc

SEQ ID NO: 49347 - DNA, 15 bp, Homo sapiens
aatataattaactca

SEQ ID NO: 49348 - DNA, 15 bp, Homo sapiens
atataattaactcac

SEQ ID NO: 49349 - DNA, 15 bp, Homo sapiens
tataattaactcacc

SEQ ID NO: 49350 - DNA, 15 bp, Homo sapiens
ataattaactcacca

SEQ ID NO: 49351 - DNA, 15 bp, Homo sapiens
taattaactcaccac

SEQ ID NO: 49352 - DNA, 15 bp, Homo sapiens
aattaactcaccaca

SEQ ID NO: 49353 - DNA, 15 bp, Homo sapiens
attaactcaccacat

SEQ ID NO: 49354 - DNA, 15 bp, Homo sapiens
ttaactcaccacatt

SEQ ID NO: 49355 - DNA, 15 bp, Homo sapiens
taactcaccacatta

SEQ ID NO: 49356 - DNA, 15 bp, Homo sapiens
aactcaccacattaa

SEQ ID NO: 49357 - DNA, 15 bp, Homo sapiens
actcaccacattaac

SEQ ID NO: 49358 - DNA, 15 bp, Homo sapiens
ctcaccacattaacc

SEQ ID NO: 49359 - DNA, 15 bp, Homo sapiens
tcaccacattaacca

SEQ ID NO: 49360 - DNA, 15 bp, Homo sapiens
caccacattaaccaa

SEQ ID NO: 49361 - DNA, 15 bp, Homo sapiens
accacattaaccaaa

SEQ ID NO: 49362 - DNA, 15 bp, Homo sapiens
ccacattaaccaaat

SEQ ID NO: 49363 - DNA, 15 bp, Homo sapiens
cacattaaccaaatt

SEQ ID NO: 49364 - DNA, 15 bp, Homo sapiens
acattaaccaaatta

SEQ ID NO: 49365 - DNA, 15 bp, Homo sapiens
cattaaccaaattaa

SEQ ID NO: 49366 - DNA, 15 bp, Homo sapiens
attaaccaaattaag

SEQ ID NO: 49367 - DNA, 15 bp, Homo sapiens
ttaaccaaattaagg

SEQ ID NO: 49368 - DNA, 15 bp, Homo sapiens
taaccaaattaaggt

SEQ ID NO: 49369 - DNA, 15 bp, Homo sapiens
aaccaaattaaggtg

SEQ ID NO: 49370 - DNA, 15 bp, Homo sapiens
accaaattaaggtgg

SEQ ID NO: 49371 - DNA, 15 bp, Homo sapiens
ccaaattaaggtgga

SEQ ID NO: 49372 - DNA, 15 bp, Homo sapiens
caaattaaggtggaa

SEQ ID NO: 49373 - DNA, 15 bp, Homo sapiens
aaattaaggtggaaa

SEQ ID NO: 49374 - DNA, 15 bp, Homo sapiens
aattaaggtggaaaa

SEQ ID NO: 49375 - DNA, 15 bp, Homo sapiens
attaaggtggaaaaa

SEQ ID NO: 49376 - DNA, 15 bp, Homo sapiens
ttaaggtggaaaaaa

SEQ ID NO: 49377 - DNA, 15 bp, Homo sapiens
taaggtggaaaaaac

SEQ ID NO: 49378 - DNA, 15 bp, Homo sapiens
aaggtggaaaaaaca

SEQ ID NO: 49379 - DNA, 15 bp, Homo sapiens
aggtggaaaaaacaa

SEQ ID NO: 49380 - DNA, 15 bp, Homo sapiens
ggtggaaaaaacaat

SEQ ID NO: 49381 - DNA, 15 bp, Homo sapiens
gtggaaaaaacaata

SEQ ID NO: 49382 - DNA, 15 bp, Homo sapiens
tggaaaaaacaataa

SEQ ID NO: 49383 - DNA, 15 bp, Homo sapiens
ggaaaaaacaataag

SEQ ID NO: 49384 - DNA, 15 bp, Homo sapiens
gaaaaaacaataagg

SEQ ID NO: 49385 - DNA, 15 bp, Homo sapiens
aaaaaacaataaggt

SEQ ID NO: 49386 - DNA, 15 bp, Homo sapiens
aaaaacaataaggtc

SEQ ID NO: 49387 - DNA, 15 bp, Homo sapiens
aaaacaataaggtca

SEQ ID NO: 49388 - DNA, 15 bp, Homo sapiens
aaacaataaggtcac

SEQ ID NO: 49389 - DNA, 15 bp, Homo sapiens
aacaataaggtcacc

SEQ ID NO: 49390 - DNA, 15 bp, Homo sapiens
acaataaggtcacct

SEQ ID NO: 49391 - DNA, 15 bp, Homo sapiens
caataaggtcacctc

SEQ ID NO: 49392 - DNA, 15 bp, Homo sapiens
aataaggtcacctca

SEQ ID NO: 49393 - DNA, 15 bp, Homo sapiens
ataaggtcacctcag

SEQ ID NO: 49394 - DNA, 15 bp, Homo sapiens
taaggtcacctcagt

SEQ ID NO: 49395 - DNA, 15 bp, Homo sapiens
aaggtcacctcagta

SEQ ID NO: 49396 - DNA, 15 bp, Homo sapiens
aggtcacctcagtag

SEQ ID NO: 49397 - DNA, 15 bp, Homo sapiens
ggtcacctcagtagg

SEQ ID NO: 49398 - DNA, 15 bp, Homo sapiens
gtcacctcagtaggt

SEQ ID NO: 49399 - DNA, 15 bp, Homo sapiens
tcacctcagtaggtg

SEQ ID NO: 49400 - DNA, 15 bp, Homo sapiens
cacctcagtaggtgc

SEQ ID NO: 49401 - DNA, 15 bp, Homo sapiens
acctcagtaggtgca

SEQ ID NO: 49402 - DNA, 15 bp, Homo sapiens
cctcagtaggtgcat

SEQ ID NO: 49403 - DNA, 15 bp, Homo sapiens
ctcagtaggtgcata

SEQ ID NO: 49404 - DNA, 15 bp, Homo sapiens
tcagtaggtgcatat

SEQ ID NO: 49405 - DNA, 15 bp, Homo sapiens
cagtaggtgcatatg

SEQ ID NO: 49406 - DNA, 15 bp, Homo sapiens
agtaggtgcatatga

SEQ ID NO: 49407 - DNA, 15 bp, Homo sapiens
gtaggtgcatatgat

SEQ ID NO: 49408 - DNA, 15 bp, Homo sapiens
taggtgcatatgatg

SEQ ID NO: 49409 - DNA, 15 bp, Homo sapiens
aggtgcatatgatga

SEQ ID NO: 49410 - DNA, 15 bp, Homo sapiens
ggtgcatatgatgaa

SEQ ID NO: 49411 - DNA, 15 bp, Homo sapiens
gtgcatatgatgaaa

SEQ ID NO: 49412 - DNA, 15 bp, Homo sapiens
tgcatatgatgaaac

SEQ ID NO: 49413 - DNA, 15 bp, Homo sapiens
gcatatgatgaaacg

SEQ ID NO: 49414 - DNA, 15 bp, Homo sapiens
catatgatgaaacgc

SEQ ID NO: 49415 - DNA, 15 bp, Homo sapiens
atatgatgaaacgca

SEQ ID NO: 49416 - DNA, 15 bp, Homo sapiens
tatgatgaaacgcat

SEQ ID NO: 49417 - DNA, 15 bp, Homo sapiens
atgatgaaacgcatc

SEQ ID NO: 49418 - DNA, 15 bp, Homo sapiens
tgatgaaacgcatct

SEQ ID NO: 49419 - DNA, 15 bp, Homo sapiens
gatgaaacgcatctt

SEQ ID NO: 49420 - DNA, 15 bp, Homo sapiens
atgaaacgcatctta

SEQ ID NO: 49421 - DNA, 15 bp, Homo sapiens
tgaaacgcatcttat

SEQ ID NO: 49422 - DNA, 15 bp, Homo sapiens
gaaacgcatcttatc

SEQ ID NO: 49423 - DNA, 15 bp, Homo sapiens
aaacgcatcttatca

SEQ ID NO: 49424 - DNA, 15 bp, Homo sapiens
aacgcatcttatcac

SEQ ID NO: 49425 - DNA, 15 bp, Homo sapiens
acgcatcttatcaca

SEQ ID NO: 49426 - DNA, 15 bp, Homo sapiens
cgcatcttatcacac

SEQ ID NO: 49427 - DNA, 15 bp, Homo sapiens
gcatcttatcacacc

SEQ ID NO: 49428 - DNA, 15 bp, Homo sapiens
catcttatcacacca

SEQ ID NO: 49429 - DNA, 15 bp, Homo sapiens
atcttatcacaccaa

SEQ ID NO: 49430 - DNA, 15 bp, Homo sapiens
tcttatcacaccaaa

SEQ ID NO: 49431 - DNA, 15 bp, Homo sapiens
cttatcacaccaaac

SEQ ID NO: 49432 - DNA, 15 bp, Homo sapiens
ttatcacaccaaact

SEQ ID NO: 49433 - DNA, 15 bp, Homo sapiens
tatcacaccaaacta

SEQ ID NO: 49434 - DNA, 15 bp, Homo sapiens
atcacaccaaactaa

SEQ ID NO: 49435 - DNA, 15 bp, Homo sapiens
tcacaccaaactaag

SEQ ID NO: 49436 - DNA, 15 bp, Homo sapiens
cacaccaaactaaga

SEQ ID NO: 49437 - DNA, 15 bp, Homo sapiens
acaccaaactaagac

SEQ ID NO: 49438 - DNA, 15 bp, Homo sapiens
caccaaactaagact

SEQ ID NO: 49439 - DNA, 15 bp, Homo sapiens
accaaactaagacta

SEQ ID NO: 49440 - DNA, 15 bp, Homo sapiens
ccaaactaagactat

SEQ ID NO: 49441 - DNA, 15 bp, Homo sapiens
caaactaagactata

SEQ ID NO: 49442 - DNA, 15 bp, Homo sapiens
aaactaagactataa

SEQ ID NO: 49443 - DNA, 15 bp, Homo sapiens
aactaagactataaa

SEQ ID NO: 49444 - DNA, 15 bp, Homo sapiens
actaagactataaaa

SEQ ID NO: 49445 - DNA, 15 bp, Homo sapiens
ctaagactataaaag

SEQ ID NO: 49446 - DNA, 15 bp, Homo sapiens
taagactataaaagt

SEQ ID NO: 49447 - DNA, 15 bp, Homo sapiens
aagactataaaagtg

SEQ ID NO: 49448 - DNA, 15 bp, Homo sapiens
agactataaaagtgt

SEQ ID NO: 49449 - DNA, 15 bp, Homo sapiens
gactataaaagtgtg

SEQ ID NO: 49450 - DNA, 15 bp, Homo sapiens
actataaaagtgtgt

SEQ ID NO: 49451 - DNA, 15 bp, Homo sapiens
ctataaaagtgtgtc

SEQ ID NO: 49452 - DNA, 15 bp, Homo sapiens
tataaaagtgtgtct

SEQ ID NO: 49453 - DNA, 15 bp, Homo sapiens
ataaaagtgtgtctt

SEQ ID NO: 49454 - DNA, 15 bp, Homo sapiens
taaaagtgtgtcttt

SEQ ID NO: 49455 - DNA, 15 bp, Homo sapiens
aaaagtgtgtcttta

SEQ ID NO: 49456 - DNA, 15 bp, Homo sapiens
aaagtgtgtctttaa

SEQ ID NO: 49457 - DNA, 15 bp, Homo sapiens
aagtgtgtctttaac

SEQ ID NO: 49458 - DNA, 15 bp, Homo sapiens
agtgtgtctttaacg

SEQ ID NO: 49459 - DNA, 15 bp, Homo sapiens
gtgtgtctttaacgc

SEQ ID NO: 49460 - DNA, 15 bp, Homo sapiens
tgtgtctttaacgct

SEQ ID NO: 49461 - DNA, 15 bp, Homo sapiens
gtgtctttaacgctg

SEQ ID NO: 49462 - DNA, 15 bp, Homo sapiens
tgtctttaacgctga

SEQ ID NO: 49463 - DNA, 15 bp, Homo sapiens
gtctttaacgctgac

SEQ ID NO: 49464 - DNA, 15 bp, Homo sapiens
tctttaacgctgaca

SEQ ID NO: 49465 - DNA, 15 bp, Homo sapiens
ctttaacgctgacag

SEQ ID NO: 49466 - DNA, 15 bp, Homo sapiens
tttaacgctgacagt

SEQ ID NO: 49467 - DNA, 15 bp, Homo sapiens
ttaacgctgacagtg

SEQ ID NO: 49468 - DNA, 15 bp, Homo sapiens
taacgctgacagtgt

SEQ ID NO: 49469 - DNA, 15 bp, Homo sapiens
aacgctgacagtgtg

SEQ ID NO: 49470 - DNA, 15 bp, Homo sapiens
acgctgacagtgtgt

SEQ ID NO: 49471 - DNA, 15 bp, Homo sapiens
cgctgacagtgtgtt

SEQ ID NO: 49472 - DNA, 15 bp, Homo sapiens
gctgacagtgtgttt

SEQ ID NO: 49473 - DNA, 15 bp, Homo sapiens
ctgacagtgtgttta

SEQ ID NO: 49474 - DNA, 15 bp, Homo sapiens
tgacagtgtgtttac

SEQ ID NO: 49475 - DNA, 15 bp, Homo sapiens
gacagtgtgtttaca

SEQ ID NO: 49476 - DNA, 15 bp, Homo sapiens
acagtgtgtttacac

SEQ ID NO: 49477 - DNA, 15 bp, Homo sapiens
cagtgtgtttacaca

SEQ ID NO: 49478 - DNA, 15 bp, Homo sapiens
agtgtgtttacacag

SEQ ID NO: 49479 - DNA, 15 bp, Homo sapiens
gtgtgtttacacaga

SEQ ID NO: 49480 - DNA, 15 bp, Homo sapiens
tgtgtttacacagag

SEQ ID NO: 49481 - DNA, 15 bp, Homo sapiens
gtgtttacacagaga

SEQ ID NO: 49482 - DNA, 15 bp, Homo sapiens
tgtttacacagagac

SEQ ID NO: 49483 - DNA, 15 bp, Homo sapiens
gtttacacagagacc

SEQ ID NO: 49484 - DNA, 15 bp, Homo sapiens
tttacacagagacca

SEQ ID NO: 49485 - DNA, 15 bp, Homo sapiens
ttacacagagaccat

SEQ ID NO: 49486 - DNA, 15 bp, Homo sapiens
tacacagagaccatg

SEQ ID NO: 49487 - DNA, 15 bp, Homo sapiens
acacagagaccatgc

SEQ ID NO: 49488 - DNA, 15 bp, Homo sapiens
cacagagaccatgct

SEQ ID NO: 49489 - DNA, 15 bp, Homo sapiens
acagagaccatgcta

SEQ ID NO: 49490 - DNA, 15 bp, Homo sapiens
cagagaccatgctaa

SEQ ID NO: 49491 - DNA, 15 bp, Homo sapiens
agagaccatgctaac

SEQ ID NO: 49492 - DNA, 15 bp, Homo sapiens
gagaccatgctaaca

SEQ ID NO: 49493 - DNA, 15 bp, Homo sapiens
agaccatgctaacat

SEQ ID NO: 49494 - DNA, 15 bp, Homo sapiens
gaccatgctaacata

SEQ ID NO: 49495 - DNA, 15 bp, Homo sapiens
accatgctaacataa

SEQ ID NO: 49496 - DNA, 15 bp, Homo sapiens
ccatgctaacataac

SEQ ID NO: 49497 - DNA, 15 bp, Homo sapiens
catgctaacataaca

SEQ ID NO: 49498 - DNA, 15 bp, Homo sapiens
atgctaacataacag

SEQ ID NO: 49499 - DNA, 15 bp, Homo sapiens
tgctaacataacaga

SEQ ID NO: 49500 - DNA, 15 bp, Homo sapiens
gctaacataacagaa

SEQ ID NO: 49501 - DNA, 15 bp, Homo sapiens
ctaacataacagaat

SEQ ID NO: 49502 - DNA, 15 bp, Homo sapiens
taacataacagaatt

SEQ ID NO: 49503 - DNA, 15 bp, Homo sapiens
aacataacagaattc

SEQ ID NO: 49504 - DNA, 15 bp, Homo sapiens
acataacagaattct

SEQ ID NO: 49505 - DNA, 15 bp, Homo sapiens
cataacagaattctc

SEQ ID NO: 49506 - DNA, 15 bp, Homo sapiens
ataacagaattctca

SEQ ID NO: 49507 - DNA, 15 bp, Homo sapiens
taacagaattctcac

SEQ ID NO: 49508 - DNA, 15 bp, Homo sapiens
aacagaattctcacc

SEQ ID NO: 49509 - DNA, 15 bp, Homo sapiens
acagaattctcacca

SEQ ID NO: 49510 - DNA, 15 bp, Homo sapiens
cagaattctcaccat

SEQ ID NO: 49511 - DNA, 15 bp, Homo sapiens
agaattctcaccatt

SEQ ID NO: 49512 - DNA, 15 bp, Homo sapiens
gaattctcaccattt

SEQ ID NO: 49513 - DNA, 15 bp, Homo sapiens
aattctcaccatttc

SEQ ID NO: 49514 - DNA, 15 bp, Homo sapiens
attctcaccatttct

SEQ ID NO: 49515 - DNA, 15 bp, Homo sapiens
ttctcaccatttcta

SEQ ID NO: 49516 - DNA, 15 bp, Homo sapiens
tctcaccatttctat

SEQ ID NO: 49517 - DNA, 15 bp, Homo sapiens
ctcaccatttctatg

SEQ ID NO: 49518 - DNA, 15 bp, Homo sapiens
tcaccatttctatgc

SEQ ID NO: 49519 - DNA, 15 bp, Homo sapiens
caccatttctatgca

SEQ ID NO: 49520 - DNA, 15 bp, Homo sapiens
accatttctatgcag

SEQ ID NO: 49521 - DNA, 15 bp, Homo sapiens
ccatttctatgcagt

SEQ ID NO: 49522 - DNA, 15 bp, Homo sapiens
catttctatgcagta

SEQ ID NO: 49523 - DNA, 15 bp, Homo sapiens
atttctatgcagtat

SEQ ID NO: 49524 - DNA, 15 bp, Homo sapiens
tttctatgcagtatt

SEQ ID NO: 49525 - DNA, 15 bp, Homo sapiens
ttctatgcagtatta

SEQ ID NO: 49526 - DNA, 15 bp, Homo sapiens
tctatgcagtattat

SEQ ID NO: 49527 - DNA, 15 bp, Homo sapiens
ctatgcagtattata

SEQ ID NO: 49528 - DNA, 15 bp, Homo sapiens
tatgcagtattatac

SEQ ID NO: 49529 - DNA, 15 bp, Homo sapiens
atgcagtattatact

SEQ ID NO: 49530 - DNA, 15 bp, Homo sapiens
tgcagtattatactg

SEQ ID NO: 49531 - DNA, 15 bp, Homo sapiens
gcagtattatactgg

SEQ ID NO: 49532 - DNA, 15 bp, Homo sapiens
cagtattatactggc

SEQ ID NO: 49533 - DNA, 15 bp, Homo sapiens
agtattatactggca

SEQ ID NO: 49534 - DNA, 15 bp, Homo sapiens
gtattatactggcat

SEQ ID NO: 49535 - DNA, 15 bp, Homo sapiens
tattatactggcatt

SEQ ID NO: 49536 - DNA, 15 bp, Homo sapiens
attatactggcattc

SEQ ID NO: 49537 - DNA, 15 bp, Homo sapiens
ttatactggcattcc

SEQ ID NO: 49538 - DNA, 15 bp, Homo sapiens
tatactggcattcct

SEQ ID NO: 49539 - DNA, 15 bp, Homo sapiens
atactggcattcctg

SEQ ID NO: 49540 - DNA, 15 bp, Homo sapiens
tactggcattcctgg

SEQ ID NO: 49541 - DNA, 15 bp, Homo sapiens
actggcattcctggt

SEQ ID NO: 49542 - DNA, 15 bp, Homo sapiens
ctggcattcctggtc

SEQ ID NO: 49543 - DNA, 15 bp, Homo sapiens
tggcattcctggtct

SEQ ID NO: 49544 - DNA, 15 bp, Homo sapiens
ggcattcctggtctg

SEQ ID NO: 49545 - DNA, 15 bp, Homo sapiens
gcattcctggtctgt

SEQ ID NO: 49546 - DNA, 15 bp, Homo sapiens
cattcctggtctgtg

SEQ ID NO: 49547 - DNA, 15 bp, Homo sapiens
attcctggtctgtgt

SEQ ID NO: 49548 - DNA, 15 bp, Homo sapiens
ttcctggtctgtgta

SEQ ID NO: 49549 - DNA, 15 bp, Homo sapiens
tcctggtctgtgtaa

SEQ ID NO: 49550 - DNA, 15 bp, Homo sapiens
cctggtctgtgtaat

SEQ ID NO: 49551 - DNA, 15 bp, Homo sapiens
ctggtctgtgtaata

SEQ ID NO: 49552 - DNA, 15 bp, Homo sapiens
tggtctgtgtaatag

SEQ ID NO: 49553 - DNA, 15 bp, Homo sapiens
ggtctgtgtaatagg

SEQ ID NO: 49554 - DNA, 15 bp, Homo sapiens
gtctgtgtaataggc

SEQ ID NO: 49555 - DNA, 15 bp, Homo sapiens
tctgtgtaataggca

SEQ ID NO: 49556 - DNA, 15 bp, Homo sapiens
ctgtgtaataggcaa

SEQ ID NO: 49557 - DNA, 15 bp, Homo sapiens
tgtgtaataggcaag

SEQ ID NO: 49558 - DNA, 15 bp, Homo sapiens
gtgtaataggcaaga

SEQ ID NO: 49559 - DNA, 15 bp, Homo sapiens
tgtaataggcaagaa

SEQ ID NO: 49560 - DNA, 15 bp, Homo sapiens
gtaataggcaagaaa

SEQ ID NO: 49561 - DNA, 15 bp, Homo sapiens
taataggcaagaaaa

SEQ ID NO: 49562 - DNA, 15 bp, Homo sapiens
aataggcaagaaaag

SEQ ID NO: 49563 - DNA, 15 bp, Homo sapiens
ataggcaagaaaagt

SEQ ID NO: 49564 - DNA, 15 bp, Homo sapiens
taggcaagaaaagta

SEQ ID NO: 49565 - DNA, 15 bp, Homo sapiens
aggcaagaaaagtac

SEQ ID NO: 49566 - DNA, 15 bp, Homo sapiens
ggcaagaaaagtaca

SEQ ID NO: 49567 - DNA, 15 bp, Homo sapiens
gcaagaaaagtacaa

SEQ ID NO: 49568 - DNA, 15 bp, Homo sapiens
caagaaaagtacaaa

SEQ ID NO: 49569 - DNA, 15 bp, Homo sapiens
aagaaaagtacaaaa

SEQ ID NO: 49570 - DNA, 15 bp, Homo sapiens
agaaaagtacaaaaa

SEQ ID NO: 49571 - DNA, 15 bp, Homo sapiens
gaaaagtacaaaaac

SEQ ID NO: 49572 - DNA, 15 bp, Homo sapiens
aaaagtacaaaaact

SEQ ID NO: 49573 - DNA, 15 bp, Homo sapiens
aaagtacaaaaactg

SEQ ID NO: 49574 - DNA, 15 bp, Homo sapiens
aagtacaaaaactgg

SEQ ID NO: 49575 - DNA, 15 bp, Homo sapiens
agtacaaaaactgga

SEQ ID NO: 49576 - DNA, 15 bp, Homo sapiens
gtacaaaaactggaa

SEQ ID NO: 49577 - DNA, 15 bp, Homo sapiens
tacaaaaactggaag

SEQ ID NO: 49578 - DNA, 15 bp, Homo sapiens
acaaaaactggaaga

SEQ ID NO: 49579 - DNA, 15 bp, Homo sapiens
caaaaactggaagag

SEQ ID NO: 49580 - DNA, 15 bp, Homo sapiens
aaaaactggaagaga

SEQ ID NO: 49581 - DNA, 15 bp, Homo sapiens
aaaactggaagagaa

SEQ ID NO: 49582 - DNA, 15 bp, Homo sapiens
aaactggaagagaag

SEQ ID NO: 49583 - DNA, 15 bp, Homo sapiens
aactggaagagaagg

SEQ ID NO: 49584 - DNA, 15 bp, Homo sapiens
actggaagagaaggg

SEQ ID NO: 49585 - DNA, 15 bp, Homo sapiens
ctggaagagaagggg

SEQ ID NO: 49586 - DNA, 15 bp, Homo sapiens
tggaagagaaggggt

SEQ ID NO: 49587 - DNA, 15 bp, Homo sapiens
ggaagagaaggggta

SEQ ID NO: 49588 - DNA, 15 bp, Homo sapiens
gaagagaaggggtat

SEQ ID NO: 49589 - DNA, 15 bp, Homo sapiens
aagagaaggggtatc

SEQ ID NO: 49590 - DNA, 15 bp, Homo sapiens
agagaaggggtatct

SEQ ID NO: 49591 - DNA, 15 bp, Homo sapiens
gagaaggggtatctt

SEQ ID NO: 49592 - DNA, 15 bp, Homo sapiens
agaaggggtatcttt

SEQ ID NO: 49593 - DNA, 15 bp, Homo sapiens
gaaggggtatcttta

SEQ ID NO: 49594 - DNA, 15 bp, Homo sapiens
aaggggtatctttag

SEQ ID NO: 49595 - DNA, 15 bp, Homo sapiens
aggggtatctttagt

SEQ ID NO: 49596 - DNA, 15 bp, Homo sapiens
ggggtatctttagtt

SEQ ID NO: 49597 - DNA, 15 bp, Homo sapiens
gggtatctttagttg

SEQ ID NO: 49598 - DNA, 15 bp, Homo sapiens
ggtatctttagttgt

SEQ ID NO: 49599 - DNA, 15 bp, Homo sapiens
gtatctttagttgta

SEQ ID NO: 49600 - DNA, 15 bp, Homo sapiens
tatctttagttgtag

SEQ ID NO: 49601 - DNA, 15 bp, Homo sapiens
atctttagttgtagg

SEQ ID NO: 49602 - DNA, 15 bp, Homo sapiens
tctttagttgtaggt

SEQ ID NO: 49603 - DNA, 15 bp, Homo sapiens
ctttagttgtaggta

SEQ ID NO: 49604 - DNA, 15 bp, Homo sapiens
tttagttgtaggtaa

SEQ ID NO: 49605 - DNA, 15 bp, Homo sapiens
ttagttgtaggtaac

SEQ ID NO: 49606 - DNA, 15 bp, Homo sapiens
tagttgtaggtaacg

SEQ ID NO: 49607 - DNA, 15 bp, Homo sapiens
agttgtaggtaacga

SEQ ID NO: 49608 - DNA, 15 bp, Homo sapiens
gttgtaggtaacgat

SEQ ID NO: 49609 - DNA, 15 bp, Homo sapiens
ttgtaggtaacgata

SEQ ID NO: 49610 - DNA, 15 bp, Homo sapiens
tgtaggtaacgatat

SEQ ID NO: 49611 - DNA, 15 bp, Homo sapiens
gtaggtaacgatata

SEQ ID NO: 49612 - DNA, 15 bp, Homo sapiens
taggtaacgatataa

SEQ ID NO: 49613 - DNA, 15 bp, Homo sapiens
aggtaacgatataaa

SEQ ID NO: 49614 - DNA, 15 bp, Homo sapiens
ggtaacgatataaag

SEQ ID NO: 49615 - DNA, 15 bp, Homo sapiens
gtaacgatataaagc

SEQ ID NO: 49616 - DNA, 15 bp, Homo sapiens
taacgatataaagcc

SEQ ID NO: 49617 - DNA, 15 bp, Homo sapiens
aacgatataaagcca

SEQ ID NO: 49618 - DNA, 15 bp, Homo sapiens
acgatataaagccaa

SEQ ID NO: 49619 - DNA, 15 bp, Homo sapiens
cgatataaagccaaa

SEQ ID NO: 49620 - DNA, 15 bp, Homo sapiens
gatataaagccaaag

SEQ ID NO: 49621 - DNA, 15 bp, Homo sapiens
atataaagccaaagg

SEQ ID NO: 49622 - DNA, 15 bp, Homo sapiens
tataaagccaaaggt

SEQ ID NO: 49623 - DNA, 15 bp, Homo sapiens
ataaagccaaaggtt

SEQ ID NO: 49624 - DNA, 15 bp, Homo sapiens
taaagccaaaggttt

SEQ ID NO: 49625 - DNA, 15 bp, Homo sapiens
aaagccaaaggttta

SEQ ID NO: 49626 - DNA, 15 bp, Homo sapiens
aagccaaaggtttat

SEQ ID NO: 49627 - DNA, 15 bp, Homo sapiens
agccaaaggtttatt

SEQ ID NO: 49628 - DNA, 15 bp, Homo sapiens
gccaaaggtttattc

SEQ ID NO: 49629 - DNA, 15 bp, Homo sapiens
ccaaaggtttattct

SEQ ID NO: 49630 - DNA, 15 bp, Homo sapiens
caaaggtttattctc

SEQ ID NO: 49631 - DNA, 15 bp, Homo sapiens
aaaggtttattctca

SEQ ID NO: 49632 - DNA, 15 bp, Homo sapiens
aaggtttattctcag

SEQ ID NO: 49633 - DNA, 15 bp, Homo sapiens
aggtttattctcagt

SEQ ID NO: 49634 - DNA, 15 bp, Homo sapiens
ggtttattctcagtc

SEQ ID NO: 49635 - DNA, 15 bp, Homo sapiens
gtttattctcagtct

SEQ ID NO: 49636 - DNA, 15 bp, Homo sapiens
tttattctcagtctt

SEQ ID NO: 49637 - DNA, 15 bp, Homo sapiens
ttattctcagtcttc

SEQ ID NO: 49638 - DNA, 15 bp, Homo sapiens
tattctcagtcttcg

SEQ ID NO: 49639 - DNA, 15 bp, Homo sapiens
attctcagtcttcgt

SEQ ID NO: 49640 - DNA, 15 bp, Homo sapiens
ttctcagtcttcgtc

SEQ ID NO: 49641 - DNA, 15 bp, Homo sapiens
tctcagtcttcgtct

SEQ ID NO: 49642 - DNA, 15 bp, Homo sapiens
ctcagtcttcgtctt

SEQ ID NO: 49643 - DNA, 15 bp, Homo sapiens
tcagtcttcgtcttc

SEQ ID NO: 49644 - DNA, 15 bp, Homo sapiens
cagtcttcgtcttcc

SEQ ID NO: 49645 - DNA, 15 bp, Homo sapiens
agtcttcgtcttcct

SEQ ID NO: 49646 - DNA, 15 bp, Homo sapiens
gtcttcgtcttccta

SEQ ID NO: 49647 - DNA, 15 bp, Homo sapiens
tcttcgtcttcctat

SEQ ID NO: 49648 - DNA, 15 bp, Homo sapiens
cttcgtcttcctatt

SEQ ID NO: 49649 - DNA, 15 bp, Homo sapiens
ttcgtcttcctattt

SEQ ID NO: 49650 - DNA, 15 bp, Homo sapiens
tcgtcttcctatttt

SEQ ID NO: 49651 - DNA, 15 bp, Homo sapiens
cgtcttcctattttg

SEQ ID NO: 49652 - DNA, 15 bp, Homo sapiens
gtcttcctattttgt

SEQ ID NO: 49653 - DNA, 15 bp, Homo sapiens
tcttcctattttgtt

SEQ ID NO: 49654 - DNA, 15 bp, Homo sapiens
cttcctattttgttg

SEQ ID NO: 49655 - DNA, 15 bp, Homo sapiens
ttcctattttgttgg

SEQ ID NO: 49656 - DNA, 15 bp, Homo sapiens
tcctattttgttggt

SEQ ID NO: 49657 - DNA, 15 bp, Homo sapiens
cctattttgttggtg

SEQ ID NO: 49658 - DNA, 15 bp, Homo sapiens
ctattttgttggtgc

SEQ ID NO: 49659 - DNA, 15 bp, Homo sapiens
tattttgttggtgct

SEQ ID NO: 49660 - DNA, 15 bp, Homo sapiens
attttgttggtgctg

SEQ ID NO: 49661 - DNA, 15 bp, Homo sapiens
ttttgttggtgctgt

SEQ ID NO: 49662 - DNA, 15 bp, Homo sapiens
tttgttggtgctgtc

SEQ ID NO: 49663 - DNA, 15 bp, Homo sapiens
ttgttggtgctgtca

SEQ ID NO: 49664 - DNA, 15 bp, Homo sapiens
tgttggtgctgtcac

SEQ ID NO: 49665 - DNA, 15 bp, Homo sapiens
gttggtgctgtcact

SEQ ID NO: 49666 - DNA, 15 bp, Homo sapiens
ttggtgctgtcactc

SEQ ID NO: 49667 - DNA, 15 bp, Homo sapiens
tggtgctgtcactcg

SEQ ID NO: 49668 - DNA, 15 bp, Homo sapiens
ggtgctgtcactcgc

SEQ ID NO: 49669 - DNA, 15 bp, Homo sapiens
gtgctgtcactcgct

SEQ ID NO: 49670 - DNA, 15 bp, Homo sapiens
tgctgtcactcgctc

SEQ ID NO: 49671 - DNA, 15 bp, Homo sapiens
gctgtcactcgctcc

SEQ ID NO: 49672 - DNA, 15 bp, Homo sapiens
ctgtcactcgctccc

SEQ ID NO: 49673 - DNA, 15 bp, Homo sapiens
tgtcactcgctccct

SEQ ID NO: 49674 - DNA, 15 bp, Homo sapiens
gtcactcgctccctc

SEQ ID NO: 49675 - DNA, 15 bp, Homo sapiens
tcactcgctccctct

SEQ ID NO: 49676 - DNA, 15 bp, Homo sapiens
cactcgctccctctt

SEQ ID NO: 49677 - DNA, 15 bp, Homo sapiens
actcgctccctcttt

SEQ ID NO: 49678 - DNA, 15 bp, Homo sapiens
ctcgctccctctttg

SEQ ID NO: 49679 - DNA, 15 bp, Homo sapiens
tcgctccctctttga

SEQ ID NO: 49680 - DNA, 15 bp, Homo sapiens
cgctccctctttgaa

SEQ ID NO: 49681 - DNA, 15 bp, Homo sapiens
gctccctctttgaag

SEQ ID NO: 49682 - DNA, 15 bp, Homo sapiens
ctccctctttgaagc

SEQ ID NO: 49683 - DNA, 15 bp, Homo sapiens
tccctctttgaagca

SEQ ID NO: 49684 - DNA, 15 bp, Homo sapiens
ccctctttgaagcac

SEQ ID NO: 49685 - DNA, 15 bp, Homo sapiens
cctctttgaagcacc

SEQ ID NO: 49686 - DNA, 15 bp, Homo sapiens
ctctttgaagcacct

SEQ ID NO: 49687 - DNA, 15 bp, Homo sapiens
tctttgaagcacctc

SEQ ID NO: 49688 - DNA, 15 bp, Homo sapiens
ctttgaagcacctct

SEQ ID NO: 49689 - DNA, 15 bp, Homo sapiens
tttgaagcacctctt

SEQ ID NO: 49690 - DNA, 15 bp, Homo sapiens
ttgaagcacctcttc

SEQ ID NO: 49691 - DNA, 15 bp, Homo sapiens
tgaagcacctcttca

SEQ ID NO: 49692 - DNA, 15 bp, Homo sapiens
gaagcacctcttcac

SEQ ID NO: 49693 - DNA, 15 bp, Homo sapiens
aagcacctcttcact

SEQ ID NO: 49694 - DNA, 15 bp, Homo sapiens
agcacctcttcactt

SEQ ID NO: 49695 - DNA, 15 bp, Homo sapiens
gcacctcttcacttg

SEQ ID NO: 49696 - DNA, 15 bp, Homo sapiens
cacctcttcacttgg

SEQ ID NO: 49697 - DNA, 15 bp, Homo sapiens
acctcttcacttggc

SEQ ID NO: 49698 - DNA, 15 bp, Homo sapiens
cctcttcacttggct

SEQ ID NO: 49699 - DNA, 15 bp, Homo sapiens
ctcttcacttggctt

SEQ ID NO: 49700 - DNA, 15 bp, Homo sapiens
tcttcacttggcttc

SEQ ID NO: 49701 - DNA, 15 bp, Homo sapiens
cttcacttggcttcc

SEQ ID NO: 49702 - DNA, 15 bp, Homo sapiens
ttcacttggcttcca

SEQ ID NO: 49703 - DNA, 15 bp, Homo sapiens
tcacttggcttccac

SEQ ID NO: 49704 - DNA, 15 bp, Homo sapiens
cacttggcttccacg

SEQ ID NO: 49705 - DNA, 15 bp, Homo sapiens
acttggcttccacga

SEQ ID NO: 49706 - DNA, 15 bp, Homo sapiens
cttggcttccacgat

SEQ ID NO: 49707 - DNA, 15 bp, Homo sapiens
ttggcttccacgatc

SEQ ID NO: 49708 - DNA, 15 bp, Homo sapiens
tggcttccacgatcc

SEQ ID NO: 49709 - DNA, 15 bp, Homo sapiens
ggcttccacgatccc

SEQ ID NO: 49710 - DNA, 15 bp, Homo sapiens
gcttccacgatccca

SEQ ID NO: 49711 - DNA, 15 bp, Homo sapiens
cttccacgatcccat

SEQ ID NO: 49712 - DNA, 15 bp, Homo sapiens
ttccacgatcccata

SEQ ID NO: 49713 - DNA, 15 bp, Homo sapiens
tccacgatcccatac

SEQ ID NO: 49714 - DNA, 15 bp, Homo sapiens
ccacgatcccatact

SEQ ID NO: 49715 - DNA, 15 bp, Homo sapiens
cacgatcccatactt

SEQ ID NO: 49716 - DNA, 15 bp, Homo sapiens
acgatcccatacttg

SEQ ID NO: 49717 - DNA, 15 bp, Homo sapiens
cgatcccatacttgc

SEQ ID NO: 49718 - DNA, 15 bp, Homo sapiens
gatcccatacttgct

SEQ ID NO: 49719 - DNA, 15 bp, Homo sapiens
atcccatacttgctc

SEQ ID NO: 49720 - DNA, 15 bp, Homo sapiens
tcccatacttgctct

SEQ ID NO: 49721 - DNA, 15 bp, Homo sapiens
cccatacttgctctc

SEQ ID NO: 49722 - DNA, 15 bp, Homo sapiens
ccatacttgctctcc

SEQ ID NO: 49723 - DNA, 15 bp, Homo sapiens
catacttgctctccc

SEQ ID NO: 49724 - DNA, 15 bp, Homo sapiens
atacttgctctccct

SEQ ID NO: 49725 - DNA, 15 bp, Homo sapiens
tacttgctctccctc

SEQ ID NO: 49726 - DNA, 15 bp, Homo sapiens
acttgctctccctcc

SEQ ID NO: 49727 - DNA, 15 bp, Homo sapiens
cttgctctccctccc

SEQ ID NO: 49728 - DNA, 15 bp, Homo sapiens
ttgctctccctccct

SEQ ID NO: 49729 - DNA, 15 bp, Homo sapiens
tgctctccctccctg

SEQ ID NO: 49730 - DNA, 15 bp, Homo sapiens
gctctccctccctgg

SEQ ID NO: 49731 - DNA, 15 bp, Homo sapiens
ctctccctccctggc

SEQ ID NO: 49732 - DNA, 15 bp, Homo sapiens
tctccctccctggcc

SEQ ID NO: 49733 - DNA, 15 bp, Homo sapiens
ctccctccctggcct

SEQ ID NO: 49734 - DNA, 15 bp, Homo sapiens
tccctccctggcctc

SEQ ID NO: 49735 - DNA, 15 bp, Homo sapiens
ccctccctggcctct

SEQ ID NO: 49736 - DNA, 15 bp, Homo sapiens
cctccctggcctctc

SEQ ID NO: 49737 - DNA, 15 bp, Homo sapiens
ctccctggcctctca

SEQ ID NO: 49738 - DNA, 15 bp, Homo sapiens
tccctggcctctcat

SEQ ID NO: 49739 - DNA, 15 bp, Homo sapiens
ccctggcctctcatt

SEQ ID NO: 49740 - DNA, 15 bp, Homo sapiens
cctggcctctcattc

SEQ ID NO: 49741 - DNA, 15 bp, Homo sapiens
ctggcctctcattcg

SEQ ID NO: 49742 - DNA, 15 bp, Homo sapiens
tggcctctcattcga

SEQ ID NO: 49743 - DNA, 15 bp, Homo sapiens
ggcctctcattcgag

SEQ ID NO: 49744 - DNA, 15 bp, Homo sapiens
gcctctcattcgagg

SEQ ID NO: 49745 - DNA, 15 bp, Homo sapiens
cctctcattcgaggt

SEQ ID NO: 49746 - DNA, 15 bp, Homo sapiens
ctctcattcgaggtc

SEQ ID NO: 49747 - DNA, 15 bp, Homo sapiens
tctcattcgaggtct

SEQ ID NO: 49748 - DNA, 15 bp, Homo sapiens
ctcattcgaggtctt

SEQ ID NO: 49749 - DNA, 15 bp, Homo sapiens
tcattcgaggtcttt

SEQ ID NO: 49750 - DNA, 15 bp, Homo sapiens
cattcgaggtctttg

SEQ ID NO: 49751 - DNA, 15 bp, Homo sapiens
attcgaggtctttgt

SEQ ID NO: 49752 - DNA, 15 bp, Homo sapiens
ttcgaggtctttgta

SEQ ID NO: 49753 - DNA, 15 bp, Homo sapiens
tcgaggtctttgtag

SEQ ID NO: 49754 - DNA, 15 bp, Homo sapiens
cgaggtctttgtagc

SEQ ID NO: 49755 - DNA, 15 bp, Homo sapiens
gaggtctttgtagct

SEQ ID NO: 49756 - DNA, 15 bp, Homo sapiens
aggtctttgtagctg

SEQ ID NO: 49757 - DNA, 15 bp, Homo sapiens
ggtctttgtagctgg

SEQ ID NO: 49758 - DNA, 15 bp, Homo sapiens
gtctttgtagctggg

SEQ ID NO: 49759 - DNA, 15 bp, Homo sapiens
tctttgtagctgggt

SEQ ID NO: 49760 - DNA, 15 bp, Homo sapiens
ctttgtagctgggtc

SEQ ID NO: 49761 - DNA, 15 bp, Homo sapiens
tttgtagctgggtct

SEQ ID NO: 49762 - DNA, 15 bp, Homo sapiens
ttgtagctgggtctt

SEQ ID NO: 49763 - DNA, 15 bp, Homo sapiens
tgtagctgggtcttt

SEQ ID NO: 49764 - DNA, 15 bp, Homo sapiens
gtagctgggtctttc

SEQ ID NO: 49765 - DNA, 15 bp, Homo sapiens
tagctgggtctttca

SEQ ID NO: 49766 - DNA, 15 bp, Homo sapiens
agctgggtctttcac

SEQ ID NO: 49767 - DNA, 15 bp, Homo sapiens
gctgggtctttcaca

SEQ ID NO: 49768 - DNA, 15 bp, Homo sapiens
ctgggtctttcacaa

SEQ ID NO: 49769 - DNA, 15 bp, Homo sapiens
tgggtctttcacaag

SEQ ID NO: 49770 - DNA, 15 bp, Homo sapiens
gggtctttcacaagg

SEQ ID NO: 49771 - DNA, 15 bp, Homo sapiens
ggtctttcacaaggc

SEQ ID NO: 49772 - DNA, 15 bp, Homo sapiens
gtctttcacaaggca

SEQ ID NO: 49773 - DNA, 15 bp, Homo sapiens
tctttcacaaggcac

SEQ ID NO: 49774 - DNA, 15 bp, Homo sapiens
ctttcacaaggcacc

SEQ ID NO: 49775 - DNA, 15 bp, Homo sapiens
tttcacaaggcacca

SEQ ID NO: 49776 - DNA, 15 bp, Homo sapiens
ttcacaaggcaccag

SEQ ID NO: 49777 - DNA, 15 bp, Homo sapiens
tcacaaggcaccagg

SEQ ID NO: 49778 - DNA, 15 bp, Homo sapiens
cacaaggcaccagga

SEQ ID NO: 49779 - DNA, 15 bp, Homo sapiens
acaaggcaccaggag

SEQ ID NO: 49780 - DNA, 15 bp, Homo sapiens
caaggcaccaggagg

SEQ ID NO: 49781 - DNA, 15 bp, Homo sapiens
aaggcaccaggaggt

SEQ ID NO: 49782 - DNA, 15 bp, Homo sapiens
aggcaccaggaggtg

SEQ ID NO: 49783 - DNA, 15 bp, Homo sapiens
ggcaccaggaggtga

SEQ ID NO: 49784 - DNA, 15 bp, Homo sapiens
gcaccaggaggtgaa

SEQ ID NO: 49785 - DNA, 15 bp, Homo sapiens
caccaggaggtgaag

SEQ ID NO: 49786 - DNA, 15 bp, Homo sapiens
accaggaggtgaagg

SEQ ID NO: 49787 - DNA, 15 bp, Homo sapiens
ccaggaggtgaaggc

SEQ ID NO: 49788 - DNA, 15 bp, Homo sapiens
caggaggtgaaggct

SEQ ID NO: 49789 - DNA, 15 bp, Homo sapiens
aggaggtgaaggctc

SEQ ID NO: 49790 - DNA, 15 bp, Homo sapiens
ggaggtgaaggctcc

SEQ ID NO: 49791 - DNA, 15 bp, Homo sapiens
gaggtgaaggctcca

SEQ ID NO: 49792 - DNA, 15 bp, Homo sapiens
aggtgaaggctccat

SEQ ID NO: 49793 - DNA, 15 bp, Homo sapiens
ggtgaaggctccata

SEQ ID NO: 49794 - DNA, 15 bp, Homo sapiens
gtgaaggctccatag

SEQ ID NO: 49795 - DNA, 15 bp, Homo sapiens
tgaaggctccatagt

SEQ ID NO: 49796 - DNA, 15 bp, Homo sapiens
gaaggctccatagtc

SEQ ID NO: 49797 - DNA, 15 bp, Homo sapiens
aaggctccatagtcc

SEQ ID NO: 49798 - DNA, 15 bp, Homo sapiens
aggctccatagtcct

SEQ ID NO: 49799 - DNA, 15 bp, Homo sapiens
ggctccatagtcctc

SEQ ID NO: 49800 - DNA, 15 bp, Homo sapiens
gctccatagtcctca

SEQ ID NO: 49801 - DNA, 15 bp, Homo sapiens
ctccatagtcctcag

SEQ ID NO: 49802 - DNA, 15 bp, Homo sapiens
tccatagtcctcagc

SEQ ID NO: 49803 - DNA, 15 bp, Homo sapiens
ccatagtcctcagcc

SEQ ID NO: 49804 - DNA, 15 bp, Homo sapiens
catagtcctcagcca

SEQ ID NO: 49805 - DNA, 15 bp, Homo sapiens
atagtcctcagccat

SEQ ID NO: 49806 - DNA, 15 bp, Homo sapiens
tagtcctcagccatt

SEQ ID NO: 49807 - DNA, 15 bp, Homo sapiens
agtcctcagccattt

SEQ ID NO: 49808 - DNA, 15 bp, Homo sapiens
gtcctcagccatttc

SEQ ID NO: 49809 - DNA, 15 bp, Homo sapiens
tcctcagccatttct

SEQ ID NO: 49810 - DNA, 15 bp, Homo sapiens
cctcagccatttctg

SEQ ID NO: 49811 - DNA, 15 bp, Homo sapiens
ctcagccatttctgt

SEQ ID NO: 49812 - DNA, 15 bp, Homo sapiens
tcagccatttctgtc

SEQ ID NO: 49813 - DNA, 15 bp, Homo sapiens
cagccatttctgtct

SEQ ID NO: 49814 - DNA, 15 bp, Homo sapiens
agccatttctgtcta

SEQ ID NO: 49815 - DNA, 15 bp, Homo sapiens
gccatttctgtctat

SEQ ID NO: 49816 - DNA, 15 bp, Homo sapiens
ccatttctgtctata

SEQ ID NO: 49817 - DNA, 15 bp, Homo sapiens
catttctgtctatag

SEQ ID NO: 49818 - DNA, 15 bp, Homo sapiens
atttctgtctatagt

SEQ ID NO: 49819 - DNA, 15 bp, Homo sapiens
tttctgtctatagtt

SEQ ID NO: 49820 - DNA, 15 bp, Homo sapiens
ttctgtctatagtta

SEQ ID NO: 49821 - DNA, 15 bp, Homo sapiens
tctgtctatagttac

SEQ ID NO: 49822 - DNA, 15 bp, Homo sapiens
ctgtctatagttact

SEQ ID NO: 49823 - DNA, 15 bp, Homo sapiens
tgtctatagttactc

SEQ ID NO: 49824 - DNA, 15 bp, Homo sapiens
gtctatagttactcc

SEQ ID NO: 49825 - DNA, 15 bp, Homo sapiens
tctatagttactccc

SEQ ID NO: 49826 - DNA, 15 bp, Homo sapiens
ctatagttactccca

SEQ ID NO: 49827 - DNA, 15 bp, Homo sapiens
tatagttactcccat

SEQ ID NO: 49828 - DNA, 15 bp, Homo sapiens
atagttactcccatg

SEQ ID NO: 49829 - DNA, 15 bp, Homo sapiens
tagttactcccatga

SEQ ID NO: 49830 - DNA, 15 bp, Homo sapiens
agttactcccatgat

SEQ ID NO: 49831 - DNA, 15 bp, Homo sapiens
gttactcccatgatc

SEQ ID NO: 49832 - DNA, 15 bp, Homo sapiens
ttactcccatgatct

SEQ ID NO: 49833 - DNA, 15 bp, Homo sapiens
tactcccatgatctc

SEQ ID NO: 49834 - DNA, 15 bp, Homo sapiens
actcccatgatctct

SEQ ID NO: 49835 - DNA, 15 bp, Homo sapiens
ctcccatgatctctt

SEQ ID NO: 49836 - DNA, 15 bp, Homo sapiens
tcccatgatctcttc

SEQ ID NO: 49837 - DNA, 15 bp, Homo sapiens
cccatgatctcttct

SEQ ID NO: 49838 - DNA, 15 bp, Homo sapiens
ccatgatctcttctg

SEQ ID NO: 49839 - DNA, 15 bp, Homo sapiens
catgatctcttctgg

SEQ ID NO: 49840 - DNA, 15 bp, Homo sapiens
atgatctcttctggt

SEQ ID NO: 49841 - DNA, 15 bp, Homo sapiens
tgatctcttctggtc

SEQ ID NO: 49842 - DNA, 15 bp, Homo sapiens
gatctcttctggtct

SEQ ID NO: 49843 - DNA, 15 bp, Homo sapiens
atctcttctggtctc

SEQ ID NO: 49844 - DNA, 15 bp, Homo sapiens
tctcttctggtctca

SEQ ID NO: 49845 - DNA, 15 bp, Homo sapiens
ctcttctggtctcat

SEQ ID NO: 49846 - DNA, 15 bp, Homo sapiens
tcttctggtctcatt

SEQ ID NO: 49847 - DNA, 15 bp, Homo sapiens
cttctggtctcatta

SEQ ID NO: 49848 - DNA, 15 bp, Homo sapiens
ttctggtctcattac

SEQ ID NO: 49849 - DNA, 15 bp, Homo sapiens
tctggtctcattact

SEQ ID NO: 49850 - DNA, 15 bp, Homo sapiens
ctggtctcattacta

SEQ ID NO: 49851 - DNA, 15 bp, Homo sapiens
tggtctcattactat

SEQ ID NO: 49852 - DNA, 15 bp, Homo sapiens
ggtctcattactata

SEQ ID NO: 49853 - DNA, 15 bp, Homo sapiens
gtctcattactataa

SEQ ID NO: 49854 - DNA, 15 bp, Homo sapiens
tctcattactataat

SEQ ID NO: 49855 - DNA, 15 bp, Homo sapiens
ctcattactataatc

SEQ ID NO: 49856 - DNA, 15 bp, Homo sapiens
tcattactataatca

SEQ ID NO: 49857 - DNA, 15 bp, Homo sapiens
cattactataatcag

SEQ ID NO: 49858 - DNA, 15 bp, Homo sapiens
attactataatcagt

SEQ ID NO: 49859 - DNA, 15 bp, Homo sapiens
ttactataatcagta

SEQ ID NO: 49860 - DNA, 15 bp, Homo sapiens
tactataatcagtag

SEQ ID NO: 49861 - DNA, 15 bp, Homo sapiens
actataatcagtagc

SEQ ID NO: 49862 - DNA, 15 bp, Homo sapiens
ctataatcagtagcc

SEQ ID NO: 49863 - DNA, 15 bp, Homo sapiens
tataatcagtagcca

SEQ ID NO: 49864 - DNA, 15 bp, Homo sapiens
ataatcagtagccac

SEQ ID NO: 49865 - DNA, 15 bp, Homo sapiens
taatcagtagccact

SEQ ID NO: 49866 - DNA, 15 bp, Homo sapiens
aatcagtagccacta

SEQ ID NO: 49867 - DNA, 15 bp, Homo sapiens
atcagtagccactag

SEQ ID NO: 49868 - DNA, 15 bp, Homo sapiens
tcagtagccactagc

SEQ ID NO: 49869 - DNA, 15 bp, Homo sapiens
cagtagccactagct

SEQ ID NO: 49870 - DNA, 15 bp, Homo sapiens
agtagccactagcta

SEQ ID NO: 49871 - DNA, 15 bp, Homo sapiens
gtagccactagctat

SEQ ID NO: 49872 - DNA, 15 bp, Homo sapiens
tagccactagctatc

SEQ ID NO: 49873 - DNA, 15 bp, Homo sapiens
agccactagctatct

SEQ ID NO: 49874 - DNA, 15 bp, Homo sapiens
gccactagctatcta

SEQ ID NO: 49875 - DNA, 15 bp, Homo sapiens
ccactagctatctaa

SEQ ID NO: 49876 - DNA, 15 bp, Homo sapiens
cactagctatctaaa

SEQ ID NO: 49877 - DNA, 15 bp, Homo sapiens
actagctatctaaaa

SEQ ID NO: 49878 - DNA, 15 bp, Homo sapiens
ctagctatctaaaac

SEQ ID NO: 49879 - DNA, 15 bp, Homo sapiens
tagctatctaaaact

SEQ ID NO: 49880 - DNA, 15 bp, Homo sapiens
agctatctaaaacta

SEQ ID NO: 49881 - DNA, 15 bp, Homo sapiens
gctatctaaaactac

SEQ ID NO: 49882 - DNA, 15 bp, Homo sapiens
ctatctaaaactact

SEQ ID NO: 49883 - DNA, 15 bp, Homo sapiens
tatctaaaactactt

SEQ ID NO: 49884 - DNA, 15 bp, Homo sapiens
atctaaaactactta

SEQ ID NO: 49885 - DNA, 15 bp, Homo sapiens
tctaaaactacttag

SEQ ID NO: 49886 - DNA, 15 bp, Homo sapiens
ctaaaactacttaga

SEQ ID NO: 49887 - DNA, 15 bp, Homo sapiens
taaaactacttagaa

SEQ ID NO: 49888 - DNA, 15 bp, Homo sapiens
aaaactacttagaat

SEQ ID NO: 49889 - DNA, 15 bp, Homo sapiens
aaactacttagaata

SEQ ID NO: 49890 - DNA, 15 bp, Homo sapiens
aactacttagaatac

SEQ ID NO: 49891 - DNA, 15 bp, Homo sapiens
actacttagaatacc

SEQ ID NO: 49892 - DNA, 15 bp, Homo sapiens
ctacttagaatacct

SEQ ID NO: 49893 - DNA, 15 bp, Homo sapiens
tacttagaataccta

SEQ ID NO: 49894 - DNA, 15 bp, Homo sapiens
acttagaatacctaa

SEQ ID NO: 49895 - DNA, 15 bp, Homo sapiens
cttagaatacctaaa

SEQ ID NO: 49896 - DNA, 15 bp, Homo sapiens
ttagaatacctaaaa

SEQ ID NO: 49897 - DNA, 15 bp, Homo sapiens
tagaatacctaaaaa

SEQ ID NO: 49898 - DNA, 15 bp, Homo sapiens
agaatacctaaaaac

SEQ ID NO: 49899 - DNA, 15 bp, Homo sapiens
gaatacctaaaaaca

SEQ ID NO: 49900 - DNA, 15 bp, Homo sapiens
aatacctaaaaacac

SEQ ID NO: 49901 - DNA, 15 bp, Homo sapiens
atacctaaaaacact

SEQ ID NO: 49902 - DNA, 15 bp, Homo sapiens
tacctaaaaacactt

SEQ ID NO: 49903 - DNA, 15 bp, Homo sapiens
acctaaaaacacttc

SEQ ID NO: 49904 - DNA, 15 bp, Homo sapiens
cctaaaaacacttcc

SEQ ID NO: 49905 - DNA, 15 bp, Homo sapiens
ctaaaaacacttcct

SEQ ID NO: 49906 - DNA, 15 bp, Homo sapiens
taaaaacacttcctt

SEQ ID NO: 49907 - DNA, 15 bp, Homo sapiens
aaaaacacttcctta

SEQ ID NO: 49908 - DNA, 15 bp, Homo sapiens
aaaacacttccttag

SEQ ID NO: 49909 - DNA, 15 bp, Homo sapiens
aaacacttccttaga

SEQ ID NO: 49910 - DNA, 15 bp, Homo sapiens
aacacttccttagat

SEQ ID NO: 49911 - DNA, 15 bp, Homo sapiens
acacttccttagatg

SEQ ID NO: 49912 - DNA, 15 bp, Homo sapiens
cacttccttagatgc

SEQ ID NO: 49913 - DNA, 15 bp, Homo sapiens
acttccttagatgcc

SEQ ID NO: 49914 - DNA, 15 bp, Homo sapiens
cttccttagatgccc

SEQ ID NO: 49915 - DNA, 15 bp, Homo sapiens
ttccttagatgccct

SEQ ID NO: 49916 - DNA, 15 bp, Homo sapiens
tccttagatgcccta

SEQ ID NO: 49917 - DNA, 15 bp, Homo sapiens
ccttagatgccctag

SEQ ID NO: 49918 - DNA, 15 bp, Homo sapiens
cttagatgccctagc

SEQ ID NO: 49919 - DNA, 15 bp, Homo sapiens
ttagatgccctagcc

SEQ ID NO: 49920 - DNA, 15 bp, Homo sapiens
tagatgccctagcca

SEQ ID NO: 49921 - DNA, 15 bp, Homo sapiens
agatgccctagccat

SEQ ID NO: 49922 - DNA, 15 bp, Homo sapiens
gatgccctagccata

SEQ ID NO: 49923 - DNA, 15 bp, Homo sapiens
atgccctagccatat

SEQ ID NO: 49924 - DNA, 15 bp, Homo sapiens
tgccctagccatatt

SEQ ID NO: 49925 - DNA, 15 bp, Homo sapiens
gccctagccatattc

SEQ ID NO: 49926 - DNA, 15 bp, Homo sapiens
ccctagccatattca

SEQ ID NO: 49927 - DNA, 15 bp, Homo sapiens
cctagccatattcac

SEQ ID NO: 49928 - DNA, 15 bp, Homo sapiens
ctagccatattcact

SEQ ID NO: 49929 - DNA, 15 bp, Homo sapiens
tagccatattcactt

SEQ ID NO: 49930 - DNA, 15 bp, Homo sapiens
agccatattcactta

SEQ ID NO: 49931 - DNA, 15 bp, Homo sapiens
gccatattcacttaa

SEQ ID NO: 49932 - DNA, 15 bp, Homo sapiens
ccatattcacttaaa

SEQ ID NO: 49933 - DNA, 15 bp, Homo sapiens
catattcacttaaag

SEQ ID NO: 49934 - DNA, 15 bp, Homo sapiens
atattcacttaaagt

SEQ ID NO: 49935 - DNA, 15 bp, Homo sapiens
tattcacttaaagtg

SEQ ID NO: 49936 - DNA, 15 bp, Homo sapiens
attcacttaaagtgc

SEQ ID NO: 49937 - DNA, 15 bp, Homo sapiens
ttcacttaaagtgct

SEQ ID NO: 49938 - DNA, 15 bp, Homo sapiens
tcacttaaagtgctt

SEQ ID NO: 49939 - DNA, 15 bp, Homo sapiens
cacttaaagtgctta

SEQ ID NO: 49940 - DNA, 15 bp, Homo sapiens
acttaaagtgcttat

SEQ ID NO: 49941 - DNA, 15 bp, Homo sapiens
cttaaagtgcttatc

SEQ ID NO: 49942 - DNA, 15 bp, Homo sapiens
ttaaagtgcttatcc

SEQ ID NO: 49943 - DNA, 15 bp, Homo sapiens
taaagtgcttatcca

SEQ ID NO: 49944 - DNA, 15 bp, Homo sapiens
aaagtgcttatccat

SEQ ID NO: 49945 - DNA, 15 bp, Homo sapiens
aagtgcttatccatc

SEQ ID NO: 49946 - DNA, 15 bp, Homo sapiens
agtgcttatccatca

SEQ ID NO: 49947 - DNA, 15 bp, Homo sapiens
gtgcttatccatcac

SEQ ID NO: 49948 - DNA, 15 bp, Homo sapiens
tgcttatccatcacg

SEQ ID NO: 49949 - DNA, 15 bp, Homo sapiens
gcttatccatcacgt

SEQ ID NO: 49950 - DNA, 15 bp, Homo sapiens
cttatccatcacgtg

SEQ ID NO: 49951 - DNA, 15 bp, Homo sapiens
ttatccatcacgtgt

SEQ ID NO: 49952 - DNA, 15 bp, Homo sapiens
tatccatcacgtgtg

SEQ ID NO: 49953 - DNA, 15 bp, Homo sapiens
atccatcacgtgtga

SEQ ID NO: 49954 - DNA, 15 bp, Homo sapiens
tccatcacgtgtgac

SEQ ID NO: 49955 - DNA, 15 bp, Homo sapiens
ccatcacgtgtgaca

SEQ ID NO: 49956 - DNA, 15 bp, Homo sapiens
catcacgtgtgacag

SEQ ID NO: 49957 - DNA, 15 bp, Homo sapiens
atcacgtgtgacagc

SEQ ID NO: 49958 - DNA, 15 bp, Homo sapiens
tcacgtgtgacagcc

SEQ ID NO: 49959 - DNA, 15 bp, Homo sapiens
cacgtgtgacagcca

SEQ ID NO: 49960 - DNA, 15 bp, Homo sapiens
acgtgtgacagccac

SEQ ID NO: 49961 - DNA, 15 bp, Homo sapiens
cgtgtgacagccaca

SEQ ID NO: 49962 - DNA, 15 bp, Homo sapiens
gtgtgacagccacat

SEQ ID NO: 49963 - DNA, 15 bp, Homo sapiens
tgtgacagccacatg

SEQ ID NO: 49964 - DNA, 15 bp, Homo sapiens
gtgacagccacatga

SEQ ID NO: 49965 - DNA, 15 bp, Homo sapiens
tgacagccacatgaa

SEQ ID NO: 49966 - DNA, 15 bp, Homo sapiens
gacagccacatgaac

SEQ ID NO: 49967 - DNA, 15 bp, Homo sapiens
acagccacatgaaca

SEQ ID NO: 49968 - DNA, 15 bp, Homo sapiens
cagccacatgaacag

SEQ ID NO: 49969 - DNA, 15 bp, Homo sapiens
agccacatgaacagt

SEQ ID NO: 49970 - DNA, 15 bp, Homo sapiens
gccacatgaacagtg

SEQ ID NO: 49971 - DNA, 15 bp, Homo sapiens
ccacatgaacagtgg

SEQ ID NO: 49972 - DNA, 15 bp, Homo sapiens
cacatgaacagtggc

SEQ ID NO: 49973 - DNA, 15 bp, Homo sapiens
acatgaacagtggcc

SEQ ID NO: 49974 - DNA, 15 bp, Homo sapiens
catgaacagtggcca

SEQ ID NO: 49975 - DNA, 15 bp, Homo sapiens
atgaacagtggccac

SEQ ID NO: 49976 - DNA, 15 bp, Homo sapiens
tgaacagtggccaca

SEQ ID NO: 49977 - DNA, 15 bp, Homo sapiens
gaacagtggccacag

SEQ ID NO: 49978 - DNA, 15 bp, Homo sapiens
aacagtggccacaga

SEQ ID NO: 49979 - DNA, 15 bp, Homo sapiens
acagtggccacagag

SEQ ID NO: 49980 - DNA, 15 bp, Homo sapiens
cagtggccacagagc

SEQ ID NO: 49981 - DNA, 15 bp, Homo sapiens
agtggccacagagca

SEQ ID NO: 49982 - DNA, 15 bp, Homo sapiens
gtggccacagagcat

SEQ ID NO: 49983 - DNA, 15 bp, Homo sapiens
tggccacagagcatt

SEQ ID NO: 49984 - DNA, 15 bp, Homo sapiens
ggccacagagcattg

SEQ ID NO: 49985 - DNA, 15 bp, Homo sapiens
gccacagagcattgc

SEQ ID NO: 49986 - DNA, 15 bp, Homo sapiens
ccacagagcattgcc

SEQ ID NO: 49987 - DNA, 15 bp, Homo sapiens
cacagagcattgcca

SEQ ID NO: 49988 - DNA, 15 bp, Homo sapiens
acagagcattgccat

SEQ ID NO: 49989 - DNA, 15 bp, Homo sapiens
cagagcattgccatc

SEQ ID NO: 49990 - DNA, 15 bp, Homo sapiens
agagcattgccatct

SEQ ID NO: 49991 - DNA, 15 bp, Homo sapiens
gagcattgccatctt

SEQ ID NO: 49992 - DNA, 15 bp, Homo sapiens
agcattgccatcttt

SEQ ID NO: 49993 - DNA, 15 bp, Homo sapiens
gcattgccatctttc

SEQ ID NO: 49994 - DNA, 15 bp, Homo sapiens
cattgccatctttca

SEQ ID NO: 49995 - DNA, 15 bp, Homo sapiens
attgccatctttcac

SEQ ID NO: 49996 - DNA, 15 bp, Homo sapiens
ttgccatctttcaca

SEQ ID NO: 49997 - DNA, 15 bp, Homo sapiens
tgccatctttcacag

SEQ ID NO: 49998 - DNA, 15 bp, Homo sapiens
gccatctttcacaga

SEQ ID NO: 49999 - DNA, 15 bp, Homo sapiens
ccatctttcacagag

SEQ ID NO: 50000 - DNA, 15 bp, Homo sapiens
catctttcacagagt

SEQ ID NO: 50001 - DNA, 15 bp, Homo sapiens
atctttcacagagtt

SEQ ID NO: 50002 - DNA, 15 bp, Homo sapiens
tctttcacagagttc

SEQ ID NO: 50003 - DNA, 15 bp, Homo sapiens
ctttcacagagttct

SEQ ID NO: 50004 - DNA, 15 bp, Homo sapiens
tttcacagagttctg

SEQ ID NO: 50005 - DNA, 15 bp, Homo sapiens
ttcacagagttctgg

SEQ ID NO: 50006 - DNA, 15 bp, Homo sapiens
tcacagagttctggt

SEQ ID NO: 50007 - DNA, 15 bp, Homo sapiens
cacagagttctggtg

SEQ ID NO: 50008 - DNA, 15 bp, Homo sapiens
acagagttctggtgg

SEQ ID NO: 50009 - DNA, 15 bp, Homo sapiens
cagagttctggtgga

SEQ ID NO: 50010 - DNA, 15 bp, Homo sapiens
agagttctggtggac

SEQ ID NO: 50011 - DNA, 15 bp, Homo sapiens
gagttctggtggaca

SEQ ID NO: 50012 - DNA, 15 bp, Homo sapiens
agttctggtggacag

SEQ ID NO: 50013 - DNA, 15 bp, Homo sapiens
gttctggtggacagc

SEQ ID NO: 50014 - DNA, 15 bp, Homo sapiens
ttctggtggacagct

SEQ ID NO: 50015 - DNA, 15 bp, Homo sapiens
tctggtggacagctc

SEQ ID NO: 50016 - DNA, 15 bp, Homo sapiens
ctggtggacagctct

SEQ ID NO: 50017 - DNA, 15 bp, Homo sapiens
tggtggacagctctg

SEQ ID NO: 50018 - DNA, 15 bp, Homo sapiens
ggtggacagctctgc

SEQ ID NO: 50019 - DNA, 15 bp, Homo sapiens
gtggacagctctgct

SEQ ID NO: 50020 - DNA, 15 bp, Homo sapiens
tggacagctctgctt

SEQ ID NO: 50021 - DNA, 15 bp, Homo sapiens
ggacagctctgcttg

SEQ ID NO: 50022 - DNA, 15 bp, Homo sapiens
gacagctctgcttgg

SEQ ID NO: 50023 - DNA, 15 bp, Homo sapiens
acagctctgcttggg

SEQ ID NO: 50024 - DNA, 15 bp, Homo sapiens
cagctctgcttgggg

SEQ ID NO: 50025 - DNA, 15 bp, Homo sapiens
agctctgcttggggc

SEQ ID NO: 50026 - DNA, 15 bp, Homo sapiens
gctctgcttggggcc

SEQ ID NO: 50027 - DNA, 15 bp, Homo sapiens
ctctgcttggggcca

SEQ ID NO: 50028 - DNA, 15 bp, Homo sapiens
tctgcttggggccat

SEQ ID NO: 50029 - DNA, 15 bp, Homo sapiens
ctgcttggggccatc

SEQ ID NO: 50030 - DNA, 15 bp, Homo sapiens
tgcttggggccatct

SEQ ID NO: 50031 - DNA, 15 bp, Homo sapiens
gcttggggccatctc

SEQ ID NO: 50032 - DNA, 15 bp, Homo sapiens
cttggggccatctct

SEQ ID NO: 50033 - DNA, 15 bp, Homo sapiens
ttggggccatctctt

SEQ ID NO: 50034 - DNA, 15 bp, Homo sapiens
tggggccatctcttc

SEQ ID NO: 50035 - DNA, 15 bp, Homo sapiens
ggggccatctcttca

SEQ ID NO: 50036 - DNA, 15 bp, Homo sapiens
gggccatctcttcac

SEQ ID NO: 50037 - DNA, 15 bp, Homo sapiens
ggccatctcttcacc

SEQ ID NO: 50038 - DNA, 15 bp, Homo sapiens
gccatctcttcacct

SEQ ID NO: 50039 - DNA, 15 bp, Homo sapiens
ccatctcttcacctc

SEQ ID NO: 50040 - DNA, 15 bp, Homo sapiens
catctcttcacctcc

SEQ ID NO: 50041 - DNA, 15 bp, Homo sapiens
atctcttcacctcca

SEQ ID NO: 50042 - DNA, 15 bp, Homo sapiens
tctcttcacctccaa

SEQ ID NO: 50043 - DNA, 15 bp, Homo sapiens
ctcttcacctccaac

SEQ ID NO: 50044 - DNA, 15 bp, Homo sapiens
tcttcacctccaacg

SEQ ID NO: 50045 - DNA, 15 bp, Homo sapiens
cttcacctccaacgt

SEQ ID NO: 50046 - DNA, 15 bp, Homo sapiens
ttcacctccaacgtt

SEQ ID NO: 50047 - DNA, 15 bp, Homo sapiens
tcacctccaacgttc

SEQ ID NO: 50048 - DNA, 15 bp, Homo sapiens
cacctccaacgttcc

SEQ ID NO: 50049 - DNA, 15 bp, Homo sapiens
acctccaacgttccc

SEQ ID NO: 50050 - DNA, 15 bp, Homo sapiens
cctccaacgttccct

SEQ ID NO: 50051 - DNA, 15 bp, Homo sapiens
ctccaacgttcccta

SEQ ID NO: 50052 - DNA, 15 bp, Homo sapiens
tccaacgttccctag

SEQ ID NO: 50053 - DNA, 15 bp, Homo sapiens
ccaacgttccctagt

SEQ ID NO: 50054 - DNA, 15 bp, Homo sapiens
caacgttccctagtt

SEQ ID NO: 50055 - DNA, 15 bp, Homo sapiens
aacgttccctagttt

SEQ ID NO: 50056 - DNA, 15 bp, Homo sapiens
acgttccctagttta

SEQ ID NO: 50057 - DNA, 15 bp, Homo sapiens
cgttccctagtttaa

SEQ ID NO: 50058 - DNA, 15 bp, Homo sapiens
gttccctagtttaag

SEQ ID NO: 50059 - DNA, 15 bp, Homo sapiens
ttccctagtttaagt

SEQ ID NO: 50060 - DNA, 15 bp, Homo sapiens
tccctagtttaagtc

SEQ ID NO: 50061 - DNA, 15 bp, Homo sapiens
ccctagtttaagtca

SEQ ID NO: 50062 - DNA, 15 bp, Homo sapiens
cctagtttaagtcag

SEQ ID NO: 50063 - DNA, 15 bp, Homo sapiens
ctagtttaagtcagt

SEQ ID NO: 50064 - DNA, 15 bp, Homo sapiens
tagtttaagtcagtg

SEQ ID NO: 50065 - DNA, 15 bp, Homo sapiens
agtttaagtcagtgt

SEQ ID NO: 50066 - DNA, 15 bp, Homo sapiens
gtttaagtcagtgtc

SEQ ID NO: 50067 - DNA, 15 bp, Homo sapiens
tttaagtcagtgtca

SEQ ID NO: 50068 - DNA, 15 bp, Homo sapiens
ttaagtcagtgtcat

SEQ ID NO: 50069 - DNA, 15 bp, Homo sapiens
taagtcagtgtcatt

SEQ ID NO: 50070 - DNA, 15 bp, Homo sapiens
aagtcagtgtcatta

SEQ ID NO: 50071 - DNA, 15 bp, Homo sapiens
agtcagtgtcattat

SEQ ID NO: 50072 - DNA, 15 bp, Homo sapiens
gtcagtgtcattata

SEQ ID NO: 50073 - DNA, 15 bp, Homo sapiens
tcagtgtcattatac

SEQ ID NO: 50074 - DNA, 15 bp, Homo sapiens
cagtgtcattatact

SEQ ID NO: 50075 - DNA, 15 bp, Homo sapiens
agtgtcattatactg

SEQ ID NO: 50076 - DNA, 15 bp, Homo sapiens
gtgtcattatactga

SEQ ID NO: 50077 - DNA, 15 bp, Homo sapiens
tgtcattatactgaa

SEQ ID NO: 50078 - DNA, 15 bp, Homo sapiens
gtcattatactgaat

SEQ ID NO: 50079 - DNA, 15 bp, Homo sapiens
tcattatactgaatg

SEQ ID NO: 50080 - DNA, 15 bp, Homo sapiens
cattatactgaatgg

SEQ ID NO: 50081 - DNA, 15 bp, Homo sapiens
attatactgaatggt

SEQ ID NO: 50082 - DNA, 15 bp, Homo sapiens
ttatactgaatggta

SEQ ID NO: 50083 - DNA, 15 bp, Homo sapiens
atactgaatggtatt

SEQ ID NO: 50084 - DNA, 15 bp, Homo sapiens
tactgaatggtattc

SEQ ID NO: 50085 - DNA, 15 bp, Homo sapiens
actgaatggtattcc

SEQ ID NO: 50086 - DNA, 15 bp, Homo sapiens
ctgaatggtattcct

SEQ ID NO: 50087 - DNA, 15 bp, Homo sapiens
tgaatggtattcctt

SEQ ID NO: 50088 - DNA, 15 bp, Homo sapiens
gaatggtattccttg

SEQ ID NO: 50089 - DNA, 15 bp, Homo sapiens
aatggtattccttgt

SEQ ID NO: 50090 - DNA, 15 bp, Homo sapiens
atggtattccttgtc

SEQ ID NO: 50091 - DNA, 15 bp, Homo sapiens
tggtattccttgtct

SEQ ID NO: 50092 - DNA, 15 bp, Homo sapiens
ggtattccttgtctc

SEQ ID NO: 50093 - DNA, 15 bp, Homo sapiens
gtattccttgtctcc

SEQ ID NO: 50094 - DNA, 15 bp, Homo sapiens
tattccttgtctccc

SEQ ID NO: 50095 - DNA, 15 bp, Homo sapiens
attccttgtctccct

SEQ ID NO: 50096 - DNA, 15 bp, Homo sapiens
ttccttgtctccctt

SEQ ID NO: 50097 - DNA, 15 bp, Homo sapiens
tccttgtctcccttc

SEQ ID NO: 50098 - DNA, 15 bp, Homo sapiens
ccttgtctcccttca

SEQ ID NO: 50099 - DNA, 15 bp, Homo sapiens
cttgtctcccttcag

SEQ ID NO: 50100 - DNA, 15 bp, Homo sapiens
ttgtctcccttcagc

SEQ ID NO: 50101 - DNA, 15 bp, Homo sapiens
tgtctcccttcagcc

SEQ ID NO: 50102 - DNA, 15 bp, Homo sapiens
gtctcccttcagcca

SEQ ID NO: 50103 - DNA, 15 bp, Homo sapiens
tctcccttcagccaa

SEQ ID NO: 50104 - DNA, 15 bp, Homo sapiens
ctcccttcagccaat

SEQ ID NO: 50105 - DNA, 15 bp, Homo sapiens
tcccttcagccaatg

SEQ ID NO: 50106 - DNA, 15 bp, Homo sapiens
cccttcagccaatgc

SEQ ID NO: 50107 - DNA, 15 bp, Homo sapiens
ccttcagccaatgct

SEQ ID NO: 50108 - DNA, 15 bp, Homo sapiens
cttcagccaatgctt

SEQ ID NO: 50109 - DNA, 15 bp, Homo sapiens
ttcagccaatgcttt

SEQ ID NO: 50110 - DNA, 15 bp, Homo sapiens
tcagccaatgctttt

SEQ ID NO: 50111 - DNA, 15 bp, Homo sapiens
cagccaatgcttttg

SEQ ID NO: 50112 - DNA, 15 bp, Homo sapiens
agccaatgcttttgt

SEQ ID NO: 50113 - DNA, 15 bp, Homo sapiens
gccaatgcttttgtt

SEQ ID NO: 50114 - DNA, 15 bp, Homo sapiens
ccaatgcttttgttt

SEQ ID NO: 50115 - DNA, 15 bp, Homo sapiens
caatgcttttgtttt

SEQ ID NO: 50116 - DNA, 15 bp, Homo sapiens
aatgcttttgttttt

SEQ ID NO: 50117 - DNA, 15 bp, Homo sapiens
atgcttttgtttttt

SEQ ID NO: 50118 - DNA, 15 bp, Homo sapiens
tgcttttgttttttg

SEQ ID NO: 50119 - DNA, 15 bp, Homo sapiens
gcttttgttttttga

SEQ ID NO: 50120 - DNA, 15 bp, Homo sapiens
cttttgttttttgag

SEQ ID NO: 50121 - DNA, 15 bp, Homo sapiens
gttttttgagatgga

SEQ ID NO: 50122 - DNA, 15 bp, Homo sapiens
ttgagatggagtttg

SEQ ID NO: 50123 - DNA, 15 bp, Homo sapiens
tgagatggagtttgc

SEQ ID NO: 50124 - DNA, 15 bp, Homo sapiens
gagatggagtttgct

SEQ ID NO: 50125 - DNA, 15 bp, Homo sapiens
agatggagtttgctc

SEQ ID NO: 50126 - DNA, 15 bp, Homo sapiens
gatggagtttgctct

SEQ ID NO: 50127 - DNA, 15 bp, Homo sapiens
atggagtttgctctt

SEQ ID NO: 50128 - DNA, 15 bp, Homo sapiens
tggagtttgctcttt

SEQ ID NO: 50129 - DNA, 15 bp, Homo sapiens
ggagtttgctctttc

SEQ ID NO: 50130 - DNA, 15 bp, Homo sapiens
gagtttgctctttcg

SEQ ID NO: 50131 - DNA, 15 bp, Homo sapiens
agtttgctctttcgt

SEQ ID NO: 50132 - DNA, 15 bp, Homo sapiens
gtttgctctttcgtc

SEQ ID NO: 50133 - DNA, 15 bp, Homo sapiens
tttgctctttcgtcc

SEQ ID NO: 50134 - DNA, 15 bp, Homo sapiens
ttgctctttcgtcca

SEQ ID NO: 50135 - DNA, 15 bp, Homo sapiens
tgctctttcgtccag

SEQ ID NO: 50136 - DNA, 15 bp, Homo sapiens
gctctttcgtccagg

SEQ ID NO: 50137 - DNA, 15 bp, Homo sapiens
ctctttcgtccaggg

SEQ ID NO: 50138 - DNA, 15 bp, Homo sapiens
tctttcgtccagggt

SEQ ID NO: 50139 - DNA, 15 bp, Homo sapiens
ctttcgtccagggtg

SEQ ID NO: 50140 - DNA, 15 bp, Homo sapiens
tttcgtccagggtgg

SEQ ID NO: 50141 - DNA, 15 bp, Homo sapiens
ttcgtccagggtgga

SEQ ID NO: 50142 - DNA, 15 bp, Homo sapiens
tcgtccagggtggag

SEQ ID NO: 50143 - DNA, 15 bp, Homo sapiens
cgtccagggtggagt

SEQ ID NO: 50144 - DNA, 15 bp, Homo sapiens
gtccagggtggagtg

SEQ ID NO: 50145 - DNA, 15 bp, Homo sapiens
tccagggtggagtga

SEQ ID NO: 50146 - DNA, 15 bp, Homo sapiens
ccagggtggagtgaa

SEQ ID NO: 50147 - DNA, 15 bp, Homo sapiens
cagggtggagtgaag

SEQ ID NO: 50148 - DNA, 15 bp, Homo sapiens
agggtggagtgaagt

SEQ ID NO: 50149 - DNA, 15 bp, Homo sapiens
gggtggagtgaagtg

SEQ ID NO: 50150 - DNA, 15 bp, Homo sapiens
ggtggagtgaagtgg

SEQ ID NO: 50151 - DNA, 15 bp, Homo sapiens
gtggagtgaagtggc

SEQ ID NO: 50152 - DNA, 15 bp, Homo sapiens
tggagtgaagtggcg

SEQ ID NO: 50153 - DNA, 15 bp, Homo sapiens
ggagtgaagtggcgc

SEQ ID NO: 50154 - DNA, 15 bp, Homo sapiens
gagtgaagtggcgca

SEQ ID NO: 50155 - DNA, 15 bp, Homo sapiens
agtgaagtggcgcaa

SEQ ID NO: 50156 - DNA, 15 bp, Homo sapiens
gtgaagtggcgcaat

SEQ ID NO: 50157 - DNA, 15 bp, Homo sapiens
tgaagtggcgcaatc

SEQ ID NO: 50158 - DNA, 15 bp, Homo sapiens
gaagtggcgcaatct

SEQ ID NO: 50159 - DNA, 15 bp, Homo sapiens
aagtggcgcaatctc

SEQ ID NO: 50160 - DNA, 15 bp, Homo sapiens
gtggcgcaatctcat

SEQ ID NO: 50161 - DNA, 15 bp, Homo sapiens
tggcgcaatctcatc

SEQ ID NO: 50162 - DNA, 15 bp, Homo sapiens
ggcgcaatctcatct

SEQ ID NO: 50163 - DNA, 15 bp, Homo sapiens
gcgcaatctcatctc

SEQ ID NO: 50164 - DNA, 15 bp, Homo sapiens
cgcaatctcatctca

SEQ ID NO: 50165 - DNA, 15 bp, Homo sapiens
gcaatctcatctcac

SEQ ID NO: 50166 - DNA, 15 bp, Homo sapiens
caatctcatctcact

SEQ ID NO: 50167 - DNA, 15 bp, Homo sapiens
aatctcatctcactg

SEQ ID NO: 50168 - DNA, 15 bp, Homo sapiens
atctcatctcactgg

SEQ ID NO: 50169 - DNA, 15 bp, Homo sapiens
tctcatctcactgga

SEQ ID NO: 50170 - DNA, 15 bp, Homo sapiens
ctcatctcactggaa

SEQ ID NO: 50171 - DNA, 15 bp, Homo sapiens
tcatctcactggaat

SEQ ID NO: 50172 - DNA, 15 bp, Homo sapiens
catctcactggaatc

SEQ ID NO: 50173 - DNA, 15 bp, Homo sapiens
atctcactggaatct

SEQ ID NO: 50174 - DNA, 15 bp, Homo sapiens
tctcactggaatctc

SEQ ID NO: 50175 - DNA, 15 bp, Homo sapiens
ctcactggaatctct

SEQ ID NO: 50176 - DNA, 15 bp, Homo sapiens
tcactggaatctctg

SEQ ID NO: 50177 - DNA, 15 bp, Homo sapiens
cactggaatctctgc

SEQ ID NO: 50178 - DNA, 15 bp, Homo sapiens
actggaatctctgcc

SEQ ID NO: 50179 - DNA, 15 bp, Homo sapiens
ctggaatctctgccc

SEQ ID NO: 50180 - DNA, 15 bp, Homo sapiens
tggaatctctgcccc

SEQ ID NO: 50181 - DNA, 15 bp, Homo sapiens
ggaatctctgccccc

SEQ ID NO: 50182 - DNA, 15 bp, Homo sapiens
gaatctctgcccccc

SEQ ID NO: 50183 - DNA, 15 bp, Homo sapiens
aatctctgcccccct

SEQ ID NO: 50184 - DNA, 15 bp, Homo sapiens
atctctgcccccctg

SEQ ID NO: 50185 - DNA, 15 bp, Homo sapiens
tctctgcccccctgg

SEQ ID NO: 50186 - DNA, 15 bp, Homo sapiens
ctctgcccccctggc

SEQ ID NO: 50187 - DNA, 15 bp, Homo sapiens
tctgcccccctggct

SEQ ID NO: 50188 - DNA, 15 bp, Homo sapiens
ctgcccccctggctt

SEQ ID NO: 50189 - DNA, 15 bp, Homo sapiens
tgcccccctggcttt

SEQ ID NO: 50190 - DNA, 15 bp, Homo sapiens
gcccccctggcttta

SEQ ID NO: 50191 - DNA, 15 bp, Homo sapiens
cccccctggctttaa

SEQ ID NO: 50192 - DNA, 15 bp, Homo sapiens
ccccctggctttaag

SEQ ID NO: 50193 - DNA, 15 bp, Homo sapiens
cccctggctttaagc

SEQ ID NO: 50194 - DNA, 15 bp, Homo sapiens
ccctggctttaagca

SEQ ID NO: 50195 - DNA, 15 bp, Homo sapiens
cctggctttaagcag

SEQ ID NO: 50196 - DNA, 15 bp, Homo sapiens
ctggctttaagcagt

SEQ ID NO: 50197 - DNA, 15 bp, Homo sapiens
tggctttaagcagtt

SEQ ID NO: 50198 - DNA, 15 bp, Homo sapiens
ggctttaagcagttc

SEQ ID NO: 50199 - DNA, 15 bp, Homo sapiens
gctttaagcagttct

SEQ ID NO: 50200 - DNA, 15 bp, Homo sapiens
ctttaagcagttctc

SEQ ID NO: 50201 - DNA, 15 bp, Homo sapiens
tttaagcagttctcc

SEQ ID NO: 50202 - DNA, 15 bp, Homo sapiens
ttaagcagttctcct

SEQ ID NO: 50203 - DNA, 15 bp, Homo sapiens
taagcagttctcctg

SEQ ID NO: 50204 - DNA, 15 bp, Homo sapiens
aagcagttctcctgc

SEQ ID NO: 50205 - DNA, 15 bp, Homo sapiens
agcagttctcctgcc

SEQ ID NO: 50206 - DNA, 15 bp, Homo sapiens
gcagttctcctgcct

SEQ ID NO: 50207 - DNA, 15 bp, Homo sapiens
cagttctcctgcctc

SEQ ID NO: 50208 - DNA, 15 bp, Homo sapiens
agttctcctgcctcg

SEQ ID NO: 50209 - DNA, 15 bp, Homo sapiens
gttctcctgcctcgg

SEQ ID NO: 50210 - DNA, 15 bp, Homo sapiens
ttctcctgcctcggc

SEQ ID NO: 50211 - DNA, 15 bp, Homo sapiens
tctcctgcctcggcc

SEQ ID NO: 50212 - DNA, 15 bp, Homo sapiens
ctcctgcctcggcct

SEQ ID NO: 50213 - DNA, 15 bp, Homo sapiens
tcctgcctcggcctc

SEQ ID NO: 50214 - DNA, 15 bp, Homo sapiens
ctgcctcggcctcct

SEQ ID NO: 50215 - DNA, 15 bp, Homo sapiens
tgcctcggcctcctg

SEQ ID NO: 50216 - DNA, 15 bp, Homo sapiens
gcctcggcctcctga

SEQ ID NO: 50217 - DNA, 15 bp, Homo sapiens
cctcggcctcctgag

SEQ ID NO: 50218 - DNA, 15 bp, Homo sapiens
ctcggcctcctgagt

SEQ ID NO: 50219 - DNA, 15 bp, Homo sapiens
tcggcctcctgagta

SEQ ID NO: 50220 - DNA, 15 bp, Homo sapiens
cggcctcctgagtag

SEQ ID NO: 50221 - DNA, 15 bp, Homo sapiens
ggcctcctgagtagc

SEQ ID NO: 50222 - DNA, 15 bp, Homo sapiens
ggattacaggtgcct

SEQ ID NO: 50223 - DNA, 15 bp, Homo sapiens
gattacaggtgcctg

SEQ ID NO: 50224 - DNA, 15 bp, Homo sapiens
attacaggtgcctgc

SEQ ID NO: 50225 - DNA, 15 bp, Homo sapiens
ttacaggtgcctgcc

SEQ ID NO: 50226 - DNA, 15 bp, Homo sapiens
tacaggtgcctgcca

SEQ ID NO: 50227 - DNA, 15 bp, Homo sapiens
acaggtgcctgccac

SEQ ID NO: 50228 - DNA, 15 bp, Homo sapiens
caggtgcctgccacc

SEQ ID NO: 50229 - DNA, 15 bp, Homo sapiens
aggtgcctgccacca

SEQ ID NO: 50230 - DNA, 15 bp, Homo sapiens
ggtgcctgccaccac

SEQ ID NO: 50231 - DNA, 15 bp, Homo sapiens
gtgcctgccaccaca

SEQ ID NO: 50232 - DNA, 15 bp, Homo sapiens
tgcctgccaccacac

SEQ ID NO: 50233 - DNA, 15 bp, Homo sapiens
gcctgccaccacacc

SEQ ID NO: 50234 - DNA, 15 bp, Homo sapiens
cctgccaccacacct

SEQ ID NO: 50235 - DNA, 15 bp, Homo sapiens
ctgccaccacaccta

SEQ ID NO: 50236 - DNA, 15 bp, Homo sapiens
tgccaccacacctag

SEQ ID NO: 50237 - DNA, 15 bp, Homo sapiens
gccaccacacctagc

SEQ ID NO: 50238 - DNA, 15 bp, Homo sapiens
ccaccacacctagct

SEQ ID NO: 50239 - DNA, 15 bp, Homo sapiens
caccacacctagcta

SEQ ID NO: 50240 - DNA, 15 bp, Homo sapiens
accacacctagctaa

SEQ ID NO: 50241 - DNA, 15 bp, Homo sapiens
ccacacctagctaat

SEQ ID NO: 50242 - DNA, 15 bp, Homo sapiens
cacacctagctaatt

SEQ ID NO: 50243 - DNA, 15 bp, Homo sapiens
acacctagctaattt

SEQ ID NO: 50244 - DNA, 15 bp, Homo sapiens
cacctagctaatttt

SEQ ID NO: 50245 - DNA, 15 bp, Homo sapiens
acctagctaattttt

SEQ ID NO: 50246 - DNA, 15 bp, Homo sapiens
cctagctaatttttg

SEQ ID NO: 50247 - DNA, 15 bp, Homo sapiens
ctagctaatttttgt

SEQ ID NO: 50248 - DNA, 15 bp, Homo sapiens
tagctaatttttgta

SEQ ID NO: 50249 - DNA, 15 bp, Homo sapiens
agctaatttttgtag

SEQ ID NO: 50250 - DNA, 15 bp, Homo sapiens
gctaatttttgtaga

SEQ ID NO: 50251 - DNA, 15 bp, Homo sapiens
ctaatttttgtagac

SEQ ID NO: 50252 - DNA, 15 bp, Homo sapiens
taatttttgtagaca

SEQ ID NO: 50253 - DNA, 15 bp, Homo sapiens
aatttttgtagacag

SEQ ID NO: 50254 - DNA, 15 bp, Homo sapiens
atttttgtagacagg

SEQ ID NO: 50255 - DNA, 15 bp, Homo sapiens
tttttgtagacaggg

SEQ ID NO: 50256 - DNA, 15 bp, Homo sapiens
ttttgtagacagggt

SEQ ID NO: 50257 - DNA, 15 bp, Homo sapiens
tttgtagacagggtt

SEQ ID NO: 50258 - DNA, 15 bp, Homo sapiens
ttgtagacagggttt

SEQ ID NO: 50259 - DNA, 15 bp, Homo sapiens
tgtagacagggtttc

SEQ ID NO: 50260 - DNA, 15 bp, Homo sapiens
gtagacagggtttca

SEQ ID NO: 50261 - DNA, 15 bp, Homo sapiens
tagacagggtttcac

SEQ ID NO: 50262 - DNA, 15 bp, Homo sapiens
tggccaggctggtca

SEQ ID NO: 50263 - DNA, 15 bp, Homo sapiens
ggccaggctggtcat

SEQ ID NO: 50264 - DNA, 15 bp, Homo sapiens
gccaggctggtcatg

SEQ ID NO: 50265 - DNA, 15 bp, Homo sapiens
ccaggctggtcatga

SEQ ID NO: 50266 - DNA, 15 bp, Homo sapiens
caggctggtcatgaa

SEQ ID NO: 50267 - DNA, 15 bp, Homo sapiens
aggctggtcatgaac

SEQ ID NO: 50268 - DNA, 15 bp, Homo sapiens
ggctggtcatgaact

SEQ ID NO: 50269 - DNA, 15 bp, Homo sapiens
gctggtcatgaactg

SEQ ID NO: 50270 - DNA, 15 bp, Homo sapiens
ctggtcatgaactgc

SEQ ID NO: 50271 - DNA, 15 bp, Homo sapiens
tggtcatgaactgct

SEQ ID NO: 50272 - DNA, 15 bp, Homo sapiens
ggtcatgaactgctg

SEQ ID NO: 50273 - DNA, 15 bp, Homo sapiens
gtcatgaactgctga

SEQ ID NO: 50274 - DNA, 15 bp, Homo sapiens
tcatgaactgctgac

SEQ ID NO: 50275 - DNA, 15 bp, Homo sapiens
catgaactgctgacc

SEQ ID NO: 50276 - DNA, 15 bp, Homo sapiens
atgaactgctgacct

SEQ ID NO: 50277 - DNA, 15 bp, Homo sapiens
tgaactgctgacctc

SEQ ID NO: 50278 - DNA, 15 bp, Homo sapiens
gaactgctgacctca

SEQ ID NO: 50279 - DNA, 15 bp, Homo sapiens
aactgctgacctcag

SEQ ID NO: 50280 - DNA, 15 bp, Homo sapiens
actgctgacctcagg

SEQ ID NO: 50281 - DNA, 15 bp, Homo sapiens
ctgctgacctcaggt

SEQ ID NO: 50282 - DNA, 15 bp, Homo sapiens
tgctgacctcaggtg

SEQ ID NO: 50283 - DNA, 15 bp, Homo sapiens
gctgacctcaggtga

SEQ ID NO: 50284 - DNA, 15 bp, Homo sapiens
ctcaggtgatccact

SEQ ID NO: 50285 - DNA, 15 bp, Homo sapiens
tcaggtgatccactg

SEQ ID NO: 50286 - DNA, 15 bp, Homo sapiens
caggtgatccactgc

SEQ ID NO: 50287 - DNA, 15 bp, Homo sapiens
aggtgatccactgca

SEQ ID NO: 50288 - DNA, 15 bp, Homo sapiens
ggtgatccactgcac

SEQ ID NO: 50289 - DNA, 15 bp, Homo sapiens
gtgatccactgcacc

SEQ ID NO: 50290 - DNA, 15 bp, Homo sapiens
tgatccactgcaccc

SEQ ID NO: 50291 - DNA, 15 bp, Homo sapiens
gatccactgcacccg

SEQ ID NO: 50292 - DNA, 15 bp, Homo sapiens
atccactgcacccga

SEQ ID NO: 50293 - DNA, 15 bp, Homo sapiens
tccactgcacccgac

SEQ ID NO: 50294 - DNA, 15 bp, Homo sapiens
ccactgcacccgacc

SEQ ID NO: 50295 - DNA, 15 bp, Homo sapiens
cactgcacccgacca

SEQ ID NO: 50296 - DNA, 15 bp, Homo sapiens
actgcacccgaccac

SEQ ID NO: 50297 - DNA, 15 bp, Homo sapiens
ctgcacccgaccacc

SEQ ID NO: 50298 - DNA, 15 bp, Homo sapiens
tgcacccgaccacct

SEQ ID NO: 50299 - DNA, 15 bp, Homo sapiens
gcacccgaccacctt

SEQ ID NO: 50300 - DNA, 15 bp, Homo sapiens
cacccgaccaccttc

SEQ ID NO: 50301 - DNA, 15 bp, Homo sapiens
acccgaccaccttca

SEQ ID NO: 50302 - DNA, 15 bp, Homo sapiens
cccgaccaccttcag

SEQ ID NO: 50303 - DNA, 15 bp, Homo sapiens
ccgaccaccttcagc

SEQ ID NO: 50304 - DNA, 15 bp, Homo sapiens
cgaccaccttcagcc

SEQ ID NO: 50305 - DNA, 15 bp, Homo sapiens
gaccaccttcagcca

SEQ ID NO: 50306 - DNA, 15 bp, Homo sapiens
accaccttcagccaa

SEQ ID NO: 50307 - DNA, 15 bp, Homo sapiens
ccaccttcagccaat

SEQ ID NO: 50308 - DNA, 15 bp, Homo sapiens
caccttcagccaatt

SEQ ID NO: 50309 - DNA, 15 bp, Homo sapiens
accttcagccaattc

SEQ ID NO: 50310 - DNA, 15 bp, Homo sapiens
ccttcagccaattct

SEQ ID NO: 50311 - DNA, 15 bp, Homo sapiens
cttcagccaattctt

SEQ ID NO: 50312 - DNA, 15 bp, Homo sapiens
ttcagccaattcttg

SEQ ID NO: 50313 - DNA, 15 bp, Homo sapiens
tcagccaattcttga

SEQ ID NO: 50314 - DNA, 15 bp, Homo sapiens
cagccaattcttgac

SEQ ID NO: 50315 - DNA, 15 bp, Homo sapiens
agccaattcttgaca

SEQ ID NO: 50316 - DNA, 15 bp, Homo sapiens
gccaattcttgacaa

SEQ ID NO: 50317 - DNA, 15 bp, Homo sapiens
ccaattcttgacaac

SEQ ID NO: 50318 - DNA, 15 bp, Homo sapiens
caattcttgacaact

SEQ ID NO: 50319 - DNA, 15 bp, Homo sapiens
aattcttgacaactg

SEQ ID NO: 50320 - DNA, 15 bp, Homo sapiens
attcttgacaactgg

SEQ ID NO: 50321 - DNA, 15 bp, Homo sapiens
ttcttgacaactgga

SEQ ID NO: 50322 - DNA, 15 bp, Homo sapiens
tcttgacaactggag

SEQ ID NO: 50323 - DNA, 15 bp, Homo sapiens
cttgacaactggagc

SEQ ID NO: 50324 - DNA, 15 bp, Homo sapiens
ttgacaactggagct

SEQ ID NO: 50325 - DNA, 15 bp, Homo sapiens
tgacaactggagctt

SEQ ID NO: 50326 - DNA, 15 bp, Homo sapiens
gacaactggagcttg

SEQ ID NO: 50327 - DNA, 15 bp, Homo sapiens
acaactggagcttga

SEQ ID NO: 50328 - DNA, 15 bp, Homo sapiens
caactggagcttgag

SEQ ID NO: 50329 - DNA, 15 bp, Homo sapiens
aactggagcttgaga

SEQ ID NO: 50330 - DNA, 15 bp, Homo sapiens
actggagcttgagac

SEQ ID NO: 50331 - DNA, 15 bp, Homo sapiens
ctggagcttgagacc

SEQ ID NO: 50332 - DNA, 15 bp, Homo sapiens
tggagcttgagaccc

SEQ ID NO: 50333 - DNA, 15 bp, Homo sapiens
ggagcttgagaccct

SEQ ID NO: 50334 - DNA, 15 bp, Homo sapiens
gagcttgagaccctc

SEQ ID NO: 50335 - DNA, 15 bp, Homo sapiens
agcttgagaccctcc

SEQ ID NO: 50336 - DNA, 15 bp, Homo sapiens
gcttgagaccctccg

SEQ ID NO: 50337 - DNA, 15 bp, Homo sapiens
cttgagaccctccgt

SEQ ID NO: 50338 - DNA, 15 bp, Homo sapiens
ttgagaccctccgtt

SEQ ID NO: 50339 - DNA, 15 bp, Homo sapiens
tgagaccctccgttg

SEQ ID NO: 50340 - DNA, 15 bp, Homo sapiens
gagaccctccgttgt

SEQ ID NO: 50341 - DNA, 15 bp, Homo sapiens
agaccctccgttgtc

SEQ ID NO: 50342 - DNA, 15 bp, Homo sapiens
gaccctccgttgtct

SEQ ID NO: 50343 - DNA, 15 bp, Homo sapiens
accctccgttgtctt

SEQ ID NO: 50344 - DNA, 15 bp, Homo sapiens
ccctccgttgtcttc

SEQ ID NO: 50345 - DNA, 15 bp, Homo sapiens
cctccgttgtcttct

SEQ ID NO: 50346 - DNA, 15 bp, Homo sapiens
ctccgttgtcttctg

SEQ ID NO: 50347 - DNA, 15 bp, Homo sapiens
tccgttgtcttctgt

SEQ ID NO: 50348 - DNA, 15 bp, Homo sapiens
ccgttgtcttctgtt

SEQ ID NO: 50349 - DNA, 15 bp, Homo sapiens
cgttgtcttctgttt

SEQ ID NO: 50350 - DNA, 15 bp, Homo sapiens
gttgtcttctgtttt

SEQ ID NO: 50351 - DNA, 15 bp, Homo sapiens
ttgtcttctgtttta

SEQ ID NO: 50352 - DNA, 15 bp, Homo sapiens
tgtcttctgttttac

SEQ ID NO: 50353 - DNA, 15 bp, Homo sapiens
gtcttctgttttact

SEQ ID NO: 50354 - DNA, 15 bp, Homo sapiens
tcttctgttttactt

SEQ ID NO: 50355 - DNA, 15 bp, Homo sapiens
cttctgttttacttg

SEQ ID NO: 50356 - DNA, 15 bp, Homo sapiens
ttctgttttacttgt

SEQ ID NO: 50357 - DNA, 15 bp, Homo sapiens
tctgttttacttgtc

SEQ ID NO: 50358 - DNA, 15 bp, Homo sapiens
ctgttttacttgtct

SEQ ID NO: 50359 - DNA, 15 bp, Homo sapiens
tgttttacttgtctt

SEQ ID NO: 50360 - DNA, 15 bp, Homo sapiens
gttttacttgtctta

SEQ ID NO: 50361 - DNA, 15 bp, Homo sapiens
ttttacttgtcttaa

SEQ ID NO: 50362 - DNA, 15 bp, Homo sapiens
tttacttgtcttaaa

SEQ ID NO: 50363 - DNA, 15 bp, Homo sapiens
ttacttgtcttaaaa

SEQ ID NO: 50364 - DNA, 15 bp, Homo sapiens
tacttgtcttaaaag

SEQ ID NO: 50365 - DNA, 15 bp, Homo sapiens
acttgtcttaaaagc

SEQ ID NO: 50366 - DNA, 15 bp, Homo sapiens
cttgtcttaaaagcc

SEQ ID NO: 50367 - DNA, 15 bp, Homo sapiens
ttgtcttaaaagcca

SEQ ID NO: 50368 - DNA, 15 bp, Homo sapiens
tgtcttaaaagccaa

SEQ ID NO: 50369 - DNA, 15 bp, Homo sapiens
gtcttaaaagccaaa

SEQ ID NO: 50370 - DNA, 15 bp, Homo sapiens
tcttaaaagccaaat

SEQ ID NO: 50371 - DNA, 15 bp, Homo sapiens
cttaaaagccaaatg

SEQ ID NO: 50372 - DNA, 15 bp, Homo sapiens
ttaaaagccaaatgc

SEQ ID NO: 50373 - DNA, 15 bp, Homo sapiens
taaaagccaaatgcc

SEQ ID NO: 50374 - DNA, 15 bp, Homo sapiens
aaaagccaaatgccc

SEQ ID NO: 50375 - DNA, 15 bp, Homo sapiens
aaagccaaatgcccc

SEQ ID NO: 50376 - DNA, 15 bp, Homo sapiens
aagccaaatgcccca

SEQ ID NO: 50377 - DNA, 15 bp, Homo sapiens
agccaaatgccccat

SEQ ID NO: 50378 - DNA, 15 bp, Homo sapiens
gccaaatgccccata

SEQ ID NO: 50379 - DNA, 15 bp, Homo sapiens
ccaaatgccccataa

SEQ ID NO: 50380 - DNA, 15 bp, Homo sapiens
caaatgccccataat

SEQ ID NO: 50381 - DNA, 15 bp, Homo sapiens
aaatgccccataatg

SEQ ID NO: 50382 - DNA, 15 bp, Homo sapiens
aatgccccataatga

SEQ ID NO: 50383 - DNA, 15 bp, Homo sapiens
atgccccataatgac

SEQ ID NO: 50384 - DNA, 15 bp, Homo sapiens
tgccccataatgact

SEQ ID NO: 50385 - DNA, 15 bp, Homo sapiens
gccccataatgactt

SEQ ID NO: 50386 - DNA, 15 bp, Homo sapiens
ccccataatgacttt

SEQ ID NO: 50387 - DNA, 15 bp, Homo sapiens
cccataatgactttt

SEQ ID NO: 50388 - DNA, 15 bp, Homo sapiens
ccataatgacttttg

SEQ ID NO: 50389 - DNA, 15 bp, Homo sapiens
cataatgacttttga

SEQ ID NO: 50390 - DNA, 15 bp, Homo sapiens
ataatgacttttgag

SEQ ID NO: 50391 - DNA, 15 bp, Homo sapiens
taatgacttttgagg

SEQ ID NO: 50392 - DNA, 15 bp, Homo sapiens
aatgacttttgaggt

SEQ ID NO: 50393 - DNA, 15 bp, Homo sapiens
atgacttttgaggtc

SEQ ID NO: 50394 - DNA, 15 bp, Homo sapiens
tgacttttgaggtct

SEQ ID NO: 50395 - DNA, 15 bp, Homo sapiens
gacttttgaggtctt

SEQ ID NO: 50396 - DNA, 15 bp, Homo sapiens
acttttgaggtctta

SEQ ID NO: 50397 - DNA, 15 bp, Homo sapiens
cttttgaggtcttaa

SEQ ID NO: 50398 - DNA, 15 bp, Homo sapiens
ttttgaggtcttaat

SEQ ID NO: 50399 - DNA, 15 bp, Homo sapiens
tttgaggtcttaatg

SEQ ID NO: 50400 - DNA, 15 bp, Homo sapiens
ttgaggtcttaatga

SEQ ID NO: 50401 - DNA, 15 bp, Homo sapiens
tgaggtcttaatgac

SEQ ID NO: 50402 - DNA, 15 bp, Homo sapiens
gaggtcttaatgacc

SEQ ID NO: 50403 - DNA, 15 bp, Homo sapiens
aggtcttaatgacct

SEQ ID NO: 50404 - DNA, 15 bp, Homo sapiens
ggtcttaatgacctg

SEQ ID NO: 50405 - DNA, 15 bp, Homo sapiens
gtcttaatgacctgc

SEQ ID NO: 50406 - DNA, 15 bp, Homo sapiens
tcttaatgacctgct

SEQ ID NO: 50407 - DNA, 15 bp, Homo sapiens
cttaatgacctgctt

SEQ ID NO: 50408 - DNA, 15 bp, Homo sapiens
ttaatgacctgcttc

SEQ ID NO: 50409 - DNA, 15 bp, Homo sapiens
taatgacctgcttct

SEQ ID NO: 50410 - DNA, 15 bp, Homo sapiens
aatgacctgcttcta

SEQ ID NO: 50411 - DNA, 15 bp, Homo sapiens
atgacctgcttctac

SEQ ID NO: 50412 - DNA, 15 bp, Homo sapiens
tgacctgcttctacc

SEQ ID NO: 50413 - DNA, 15 bp, Homo sapiens
gacctgcttctacca

SEQ ID NO: 50414 - DNA, 15 bp, Homo sapiens
acctgcttctaccat

SEQ ID NO: 50415 - DNA, 15 bp, Homo sapiens
cctgcttctaccatc

SEQ ID NO: 50416 - DNA, 15 bp, Homo sapiens
ctgcttctaccatcc

SEQ ID NO: 50417 - DNA, 15 bp, Homo sapiens
tgcttctaccatcct

SEQ ID NO: 50418 - DNA, 15 bp, Homo sapiens
gcttctaccatcctc

SEQ ID NO: 50419 - DNA, 15 bp, Homo sapiens
cttctaccatcctct

SEQ ID NO: 50420 - DNA, 15 bp, Homo sapiens
ttctaccatcctctg

SEQ ID NO: 50421 - DNA, 15 bp, Homo sapiens
tctaccatcctctgc

SEQ ID NO: 50422 - DNA, 15 bp, Homo sapiens
ctaccatcctctgcc

SEQ ID NO: 50423 - DNA, 15 bp, Homo sapiens
taccatcctctgcca

SEQ ID NO: 50424 - DNA, 15 bp, Homo sapiens
accatcctctgccat

SEQ ID NO: 50425 - DNA, 15 bp, Homo sapiens
ccatcctctgccatt

SEQ ID NO: 50426 - DNA, 15 bp, Homo sapiens
catcctctgccatta

SEQ ID NO: 50427 - DNA, 15 bp, Homo sapiens
atcctctgccattac

SEQ ID NO: 50428 - DNA, 15 bp, Homo sapiens
tcctctgccattacc

SEQ ID NO: 50429 - DNA, 15 bp, Homo sapiens
cctctgccattacct

SEQ ID NO: 50430 - DNA, 15 bp, Homo sapiens
ctctgccattacctg

SEQ ID NO: 50431 - DNA, 15 bp, Homo sapiens
tctgccattacctgc

SEQ ID NO: 50432 - DNA, 15 bp, Homo sapiens
ctgccattacctgcc

SEQ ID NO: 50433 - DNA, 15 bp, Homo sapiens
tgccattacctgcct

SEQ ID NO: 50434 - DNA, 15 bp, Homo sapiens
gccattacctgcctc

SEQ ID NO: 50435 - DNA, 15 bp, Homo sapiens
ccattacctgcctca

SEQ ID NO: 50436 - DNA, 15 bp, Homo sapiens
cattacctgcctcac

SEQ ID NO: 50437 - DNA, 15 bp, Homo sapiens
attacctgcctcacc

SEQ ID NO: 50438 - DNA, 15 bp, Homo sapiens
ttacctgcctcacct

SEQ ID NO: 50439 - DNA, 15 bp, Homo sapiens
tacctgcctcacctt

SEQ ID NO: 50440 - DNA, 15 bp, Homo sapiens
acctgcctcaccttt

SEQ ID NO: 50441 - DNA, 15 bp, Homo sapiens
cctgcctcacctttt

SEQ ID NO: 50442 - DNA, 15 bp, Homo sapiens
ctgcctcaccttttg

SEQ ID NO: 50443 - DNA, 15 bp, Homo sapiens
tgcctcaccttttgc

SEQ ID NO: 50444 - DNA, 15 bp, Homo sapiens
gcctcaccttttgct

SEQ ID NO: 50445 - DNA, 15 bp, Homo sapiens
cctcaccttttgctc

SEQ ID NO: 50446 - DNA, 15 bp, Homo sapiens
ctcaccttttgctca

SEQ ID NO: 50447 - DNA, 15 bp, Homo sapiens
tcaccttttgctcat

SEQ ID NO: 50448 - DNA, 15 bp, Homo sapiens
caccttttgctcatg

SEQ ID NO: 50449 - DNA, 15 bp, Homo sapiens
accttttgctcatgt

SEQ ID NO: 50450 - DNA, 15 bp, Homo sapiens
ccttttgctcatgta

SEQ ID NO: 50451 - DNA, 15 bp, Homo sapiens
cttttgctcatgtaa

SEQ ID NO: 50452 - DNA, 15 bp, Homo sapiens
ttttgctcatgtaaa

SEQ ID NO: 50453 - DNA, 15 bp, Homo sapiens
tttgctcatgtaaac

SEQ ID NO: 50454 - DNA, 15 bp, Homo sapiens
ttgctcatgtaaact

SEQ ID NO: 50455 - DNA, 15 bp, Homo sapiens
tgctcatgtaaactc

SEQ ID NO: 50456 - DNA, 15 bp, Homo sapiens
gctcatgtaaactct

SEQ ID NO: 50457 - DNA, 15 bp, Homo sapiens
ctcatgtaaactcta

SEQ ID NO: 50458 - DNA, 15 bp, Homo sapiens
tcatgtaaactctat

SEQ ID NO: 50459 - DNA, 15 bp, Homo sapiens
catgtaaactctatt

SEQ ID NO: 50460 - DNA, 15 bp, Homo sapiens
atgtaaactctattc

SEQ ID NO: 50461 - DNA, 15 bp, Homo sapiens
tgtaaactctattcc

SEQ ID NO: 50462 - DNA, 15 bp, Homo sapiens
gtaaactctattcca

SEQ ID NO: 50463 - DNA, 15 bp, Homo sapiens
taaactctattccag

SEQ ID NO: 50464 - DNA, 15 bp, Homo sapiens
aaactctattccagc

SEQ ID NO: 50465 - DNA, 15 bp, Homo sapiens
aactctattccagcc

SEQ ID NO: 50466 - DNA, 15 bp, Homo sapiens
actctattccagcca

SEQ ID NO: 50467 - DNA, 15 bp, Homo sapiens
ctctattccagccac

SEQ ID NO: 50468 - DNA, 15 bp, Homo sapiens
tctattccagccacg

SEQ ID NO: 50469 - DNA, 15 bp, Homo sapiens
ctattccagccacgt

SEQ ID NO: 50470 - DNA, 15 bp, Homo sapiens
tattccagccacgtt

SEQ ID NO: 50471 - DNA, 15 bp, Homo sapiens
attccagccacgttg

SEQ ID NO: 50472 - DNA, 15 bp, Homo sapiens
ttccagccacgttgg

SEQ ID NO: 50473 - DNA, 15 bp, Homo sapiens
tccagccacgttggc

SEQ ID NO: 50474 - DNA, 15 bp, Homo sapiens
ccagccacgttggca

SEQ ID NO: 50475 - DNA, 15 bp, Homo sapiens
cagccacgttggcac

SEQ ID NO: 50476 - DNA, 15 bp, Homo sapiens
agccacgttggcact

SEQ ID NO: 50477 - DNA, 15 bp, Homo sapiens
gccacgttggcactc

SEQ ID NO: 50478 - DNA, 15 bp, Homo sapiens
ccacgttggcactcc

SEQ ID NO: 50479 - DNA, 15 bp, Homo sapiens
cacgttggcactcct

SEQ ID NO: 50480 - DNA, 15 bp, Homo sapiens
acgttggcactcctt

SEQ ID NO: 50481 - DNA, 15 bp, Homo sapiens
cgttggcactccttt

SEQ ID NO: 50482 - DNA, 15 bp, Homo sapiens
gttggcactccttta

SEQ ID NO: 50483 - DNA, 15 bp, Homo sapiens
ttggcactcctttac

SEQ ID NO: 50484 - DNA, 15 bp, Homo sapiens
tggcactcctttacc

SEQ ID NO: 50485 - DNA, 15 bp, Homo sapiens
ggcactcctttacca

SEQ ID NO: 50486 - DNA, 15 bp, Homo sapiens
gcactcctttaccat

SEQ ID NO: 50487 - DNA, 15 bp, Homo sapiens
cactcctttaccatt

SEQ ID NO: 50488 - DNA, 15 bp, Homo sapiens
actcctttaccattc

SEQ ID NO: 50489 - DNA, 15 bp, Homo sapiens
ctcctttaccattcc

SEQ ID NO: 50490 - DNA, 15 bp, Homo sapiens
tcctttaccattcca

SEQ ID NO: 50491 - DNA, 15 bp, Homo sapiens
cctttaccattccag

SEQ ID NO: 50492 - DNA, 15 bp, Homo sapiens
ctttaccattccagg

SEQ ID NO: 50493 - DNA, 15 bp, Homo sapiens
tttaccattccagga

SEQ ID NO: 50494 - DNA, 15 bp, Homo sapiens
ttaccattccaggac

SEQ ID NO: 50495 - DNA, 15 bp, Homo sapiens
taccattccaggact

SEQ ID NO: 50496 - DNA, 15 bp, Homo sapiens
accattccaggactt

SEQ ID NO: 50497 - DNA, 15 bp, Homo sapiens
ccattccaggacttg

SEQ ID NO: 50498 - DNA, 15 bp, Homo sapiens
cattccaggacttgc

SEQ ID NO: 50499 - DNA, 15 bp, Homo sapiens
attccaggacttgcc

SEQ ID NO: 50500 - DNA, 15 bp, Homo sapiens
ttccaggacttgcca

SEQ ID NO: 50501 - DNA, 15 bp, Homo sapiens
tccaggacttgccag

SEQ ID NO: 50502 - DNA, 15 bp, Homo sapiens
ccaggacttgccagg

SEQ ID NO: 50503 - DNA, 15 bp, Homo sapiens
caggacttgccaggt

SEQ ID NO: 50504 - DNA, 15 bp, Homo sapiens
aggacttgccaggtt

SEQ ID NO: 50505 - DNA, 15 bp, Homo sapiens
ggacttgccaggttg

SEQ ID NO: 50506 - DNA, 15 bp, Homo sapiens
gacttgccaggttgc

SEQ ID NO: 50507 - DNA, 15 bp, Homo sapiens
acttgccaggttgca

SEQ ID NO: 50508 - DNA, 15 bp, Homo sapiens
cttgccaggttgcac

SEQ ID NO: 50509 - DNA, 15 bp, Homo sapiens
ttgccaggttgcact

SEQ ID NO: 50510 - DNA, 15 bp, Homo sapiens
tgccaggttgcactt

SEQ ID NO: 50511 - DNA, 15 bp, Homo sapiens
gccaggttgcacttc

SEQ ID NO: 50512 - DNA, 15 bp, Homo sapiens
ccaggttgcacttcc

SEQ ID NO: 50513 - DNA, 15 bp, Homo sapiens
caggttgcacttccg

SEQ ID NO: 50514 - DNA, 15 bp, Homo sapiens
aggttgcacttccgt

SEQ ID NO: 50515 - DNA, 15 bp, Homo sapiens
ggttgcacttccgtt

SEQ ID NO: 50516 - DNA, 15 bp, Homo sapiens
gttgcacttccgttc

SEQ ID NO: 50517 - DNA, 15 bp, Homo sapiens
ttgcacttccgttct

SEQ ID NO: 50518 - DNA, 15 bp, Homo sapiens
tgcacttccgttctc

SEQ ID NO: 50519 - DNA, 15 bp, Homo sapiens
gcacttccgttctct

SEQ ID NO: 50520 - DNA, 15 bp, Homo sapiens
cacttccgttctctg

SEQ ID NO: 50521 - DNA, 15 bp, Homo sapiens
acttccgttctctgc

SEQ ID NO: 50522 - DNA, 15 bp, Homo sapiens
cttccgttctctgcc

SEQ ID NO: 50523 - DNA, 15 bp, Homo sapiens
ttccgttctctgcct

SEQ ID NO: 50524 - DNA, 15 bp, Homo sapiens
tccgttctctgcctg

SEQ ID NO: 50525 - DNA, 15 bp, Homo sapiens
ccgttctctgcctgg

SEQ ID NO: 50526 - DNA, 15 bp, Homo sapiens
cgttctctgcctggt

SEQ ID NO: 50527 - DNA, 15 bp, Homo sapiens
gttctctgcctggtg

SEQ ID NO: 50528 - DNA, 15 bp, Homo sapiens
ttctctgcctggtgg

SEQ ID NO: 50529 - DNA, 15 bp, Homo sapiens
tctctgcctggtggg

SEQ ID NO: 50530 - DNA, 15 bp, Homo sapiens
ctctgcctggtgggt

SEQ ID NO: 50531 - DNA, 15 bp, Homo sapiens
tctgcctggtgggtc

SEQ ID NO: 50532 - DNA, 15 bp, Homo sapiens
ctgcctggtgggtct

SEQ ID NO: 50533 - DNA, 15 bp, Homo sapiens
tgcctggtgggtctt

SEQ ID NO: 50534 - DNA, 15 bp, Homo sapiens
gcctggtgggtcttc

SEQ ID NO: 50535 - DNA, 15 bp, Homo sapiens
cctggtgggtcttca

SEQ ID NO: 50536 - DNA, 15 bp, Homo sapiens
ctggtgggtcttcac

SEQ ID NO: 50537 - DNA, 15 bp, Homo sapiens
tggtgggtcttcacc

SEQ ID NO: 50538 - DNA, 15 bp, Homo sapiens
ggtgggtcttcacca

SEQ ID NO: 50539 - DNA, 15 bp, Homo sapiens
gtgggtcttcaccac

SEQ ID NO: 50540 - DNA, 15 bp, Homo sapiens
tgggtcttcaccacc

SEQ ID NO: 50541 - DNA, 15 bp, Homo sapiens
gggtcttcaccacca

SEQ ID NO: 50542 - DNA, 15 bp, Homo sapiens
ggtcttcaccaccac

SEQ ID NO: 50543 - DNA, 15 bp, Homo sapiens
gtcttcaccaccacc

SEQ ID NO: 50544 - DNA, 15 bp, Homo sapiens
tcttcaccaccaccc

SEQ ID NO: 50545 - DNA, 15 bp, Homo sapiens
cttcaccaccaccca

SEQ ID NO: 50546 - DNA, 15 bp, Homo sapiens
ttcaccaccacccac

SEQ ID NO: 50547 - DNA, 15 bp, Homo sapiens
tcaccaccacccact

SEQ ID NO: 50548 - DNA, 15 bp, Homo sapiens
caccaccacccactg

SEQ ID NO: 50549 - DNA, 15 bp, Homo sapiens
accaccacccactgg

SEQ ID NO: 50550 - DNA, 15 bp, Homo sapiens
ccaccacccactggg

SEQ ID NO: 50551 - DNA, 15 bp, Homo sapiens
caccacccactgggt

SEQ ID NO: 50552 - DNA, 15 bp, Homo sapiens
accacccactgggtt

SEQ ID NO: 50553 - DNA, 15 bp, Homo sapiens
ccacccactgggttc

SEQ ID NO: 50554 - DNA, 15 bp, Homo sapiens
cacccactgggttca

SEQ ID NO: 50555 - DNA, 15 bp, Homo sapiens
acccactgggttcac

SEQ ID NO: 50556 - DNA, 15 bp, Homo sapiens
cccactgggttcaca

SEQ ID NO: 50557 - DNA, 15 bp, Homo sapiens
ccactgggttcacac

SEQ ID NO: 50558 - DNA, 15 bp, Homo sapiens
cactgggttcacaca

SEQ ID NO: 50559 - DNA, 15 bp, Homo sapiens
actgggttcacacac

SEQ ID NO: 50560 - DNA, 15 bp, Homo sapiens
ctgggttcacacaca

SEQ ID NO: 50561 - DNA, 15 bp, Homo sapiens
tgggttcacacacat

SEQ ID NO: 50562 - DNA, 15 bp, Homo sapiens
gggttcacacacatc

SEQ ID NO: 50563 - DNA, 15 bp, Homo sapiens
ggttcacacacatct

SEQ ID NO: 50564 - DNA, 15 bp, Homo sapiens
gttcacacacatctt

SEQ ID NO: 50565 - DNA, 15 bp, Homo sapiens
ttcacacacatcttt

SEQ ID NO: 50566 - DNA, 15 bp, Homo sapiens
tcacacacatctttt

SEQ ID NO: 50567 - DNA, 15 bp, Homo sapiens
cacacacatcttttc

SEQ ID NO: 50568 - DNA, 15 bp, Homo sapiens
acacacatcttttca

SEQ ID NO: 50569 - DNA, 15 bp, Homo sapiens
cacacatcttttcag

SEQ ID NO: 50570 - DNA, 15 bp, Homo sapiens
acacatcttttcagg

SEQ ID NO: 50571 - DNA, 15 bp, Homo sapiens
cacatcttttcaggc

SEQ ID NO: 50572 - DNA, 15 bp, Homo sapiens
acatcttttcaggcc

SEQ ID NO: 50573 - DNA, 15 bp, Homo sapiens
catcttttcaggccc

SEQ ID NO: 50574 - DNA, 15 bp, Homo sapiens
atcttttcaggcccc

SEQ ID NO: 50575 - DNA, 15 bp, Homo sapiens
tcttttcaggcccca

SEQ ID NO: 50576 - DNA, 15 bp, Homo sapiens
cttttcaggccccat

SEQ ID NO: 50577 - DNA, 15 bp, Homo sapiens
ttttcaggccccatg

SEQ ID NO: 50578 - DNA, 15 bp, Homo sapiens
tttcaggccccatgg

SEQ ID NO: 50579 - DNA, 15 bp, Homo sapiens
ttcaggccccatggg

SEQ ID NO: 50580 - DNA, 15 bp, Homo sapiens
tcaggccccatgggg

SEQ ID NO: 50581 - DNA, 15 bp, Homo sapiens
caggccccatggggc

SEQ ID NO: 50582 - DNA, 15 bp, Homo sapiens
aggccccatggggcc

SEQ ID NO: 50583 - DNA, 15 bp, Homo sapiens
ggccccatggggcca

SEQ ID NO: 50584 - DNA, 15 bp, Homo sapiens
gccccatggggccat

SEQ ID NO: 50585 - DNA, 15 bp, Homo sapiens
ccccatggggccatc

SEQ ID NO: 50586 - DNA, 15 bp, Homo sapiens
cccatggggccatct

SEQ ID NO: 50587 - DNA, 15 bp, Homo sapiens
ccatggggccatctt

SEQ ID NO: 50588 - DNA, 15 bp, Homo sapiens
catggggccatcttt

SEQ ID NO: 50589 - DNA, 15 bp, Homo sapiens
atggggccatcttta

SEQ ID NO: 50590 - DNA, 15 bp, Homo sapiens
tggggccatctttat

SEQ ID NO: 50591 - DNA, 15 bp, Homo sapiens
ggggccatctttatt

SEQ ID NO: 50592 - DNA, 15 bp, Homo sapiens
gggccatctttattc

SEQ ID NO: 50593 - DNA, 15 bp, Homo sapiens
ggccatctttattca

SEQ ID NO: 50594 - DNA, 15 bp, Homo sapiens
gccatctttattcaa

SEQ ID NO: 50595 - DNA, 15 bp, Homo sapiens
ccatctttattcaaa

SEQ ID NO: 50596 - DNA, 15 bp, Homo sapiens
catctttattcaaat

SEQ ID NO: 50597 - DNA, 15 bp, Homo sapiens
atctttattcaaatg

SEQ ID NO: 50598 - DNA, 15 bp, Homo sapiens
tctttattcaaatgt

SEQ ID NO: 50599 - DNA, 15 bp, Homo sapiens
ctttattcaaatgtc

SEQ ID NO: 50600 - DNA, 15 bp, Homo sapiens
tttattcaaatgtca

SEQ ID NO: 50601 - DNA, 15 bp, Homo sapiens
ttattcaaatgtcac

SEQ ID NO: 50602 - DNA, 15 bp, Homo sapiens
tattcaaatgtcacc

SEQ ID NO: 50603 - DNA, 15 bp, Homo sapiens
attcaaatgtcaccg

SEQ ID NO: 50604 - DNA, 15 bp, Homo sapiens
ttcaaatgtcaccgc

SEQ ID NO: 50605 - DNA, 15 bp, Homo sapiens
tcaaatgtcaccgcc

SEQ ID NO: 50606 - DNA, 15 bp, Homo sapiens
caaatgtcaccgcct

SEQ ID NO: 50607 - DNA, 15 bp, Homo sapiens
aaatgtcaccgcctt

SEQ ID NO: 50608 - DNA, 15 bp, Homo sapiens
aatgtcaccgccttc

SEQ ID NO: 50609 - DNA, 15 bp, Homo sapiens
atgtcaccgccttct

SEQ ID NO: 50610 - DNA, 15 bp, Homo sapiens
tgtcaccgccttctg

SEQ ID NO: 50611 - DNA, 15 bp, Homo sapiens
gtcaccgccttctgg

SEQ ID NO: 50612 - DNA, 15 bp, Homo sapiens
tcaccgccttctggc

SEQ ID NO: 50613 - DNA, 15 bp, Homo sapiens
caccgccttctggcc

SEQ ID NO: 50614 - DNA, 15 bp, Homo sapiens
accgccttctggcca

SEQ ID NO: 50615 - DNA, 15 bp, Homo sapiens
ccgccttctggccac

SEQ ID NO: 50616 - DNA, 15 bp, Homo sapiens
cgccttctggccact

SEQ ID NO: 50617 - DNA, 15 bp, Homo sapiens
gccttctggccactt

SEQ ID NO: 50618 - DNA, 15 bp, Homo sapiens
ccttctggccacttt

SEQ ID NO: 50619 - DNA, 15 bp, Homo sapiens
cttctggccacttta

SEQ ID NO: 50620 - DNA, 15 bp, Homo sapiens
ttctggccactttat

SEQ ID NO: 50621 - DNA, 15 bp, Homo sapiens
tctggccactttatg

SEQ ID NO: 50622 - DNA, 15 bp, Homo sapiens
ctggccactttatgt

SEQ ID NO: 50623 - DNA, 15 bp, Homo sapiens
tggccactttatgta

SEQ ID NO: 50624 - DNA, 15 bp, Homo sapiens
ggccactttatgtaa

SEQ ID NO: 50625 - DNA, 15 bp, Homo sapiens
gccactttatgtaac

SEQ ID NO: 50626 - DNA, 15 bp, Homo sapiens
ccactttatgtaaca

SEQ ID NO: 50627 - DNA, 15 bp, Homo sapiens
cactttatgtaacag

SEQ ID NO: 50628 - DNA, 15 bp, Homo sapiens
actttatgtaacagt

SEQ ID NO: 50629 - DNA, 15 bp, Homo sapiens
ctttatgtaacagtt

SEQ ID NO: 50630 - DNA, 15 bp, Homo sapiens
tttatgtaacagttc

SEQ ID NO: 50631 - DNA, 15 bp, Homo sapiens
ttatgtaacagttca

SEQ ID NO: 50632 - DNA, 15 bp, Homo sapiens
tatgtaacagttcat

SEQ ID NO: 50633 - DNA, 15 bp, Homo sapiens
atgtaacagttcata

SEQ ID NO: 50634 - DNA, 15 bp, Homo sapiens
tgtaacagttcatat

SEQ ID NO: 50635 - DNA, 15 bp, Homo sapiens
gtaacagttcatatg

SEQ ID NO: 50636 - DNA, 15 bp, Homo sapiens
taacagttcatatgt

SEQ ID NO: 50637 - DNA, 15 bp, Homo sapiens
aacagttcatatgta

SEQ ID NO: 50638 - DNA, 15 bp, Homo sapiens
acagttcatatgtat

SEQ ID NO: 50639 - DNA, 15 bp, Homo sapiens
cagttcatatgtatg

SEQ ID NO: 50640 - DNA, 15 bp, Homo sapiens
agttcatatgtatgt

SEQ ID NO: 50641 - DNA, 15 bp, Homo sapiens
gttcatatgtatgta

SEQ ID NO: 50642 - DNA, 15 bp, Homo sapiens
ttcatatgtatgtat

SEQ ID NO: 50643 - DNA, 15 bp, Homo sapiens
tcatatgtatgtatg

SEQ ID NO: 50644 - DNA, 15 bp, Homo sapiens
catatgtatgtatgc

SEQ ID NO: 50645 - DNA, 15 bp, Homo sapiens
atatgtatgtatgca

SEQ ID NO: 50646 - DNA, 15 bp, Homo sapiens
tatgtatgtatgcaa

SEQ ID NO: 50647 - DNA, 15 bp, Homo sapiens
atgtatgtatgcaaa

SEQ ID NO: 50648 - DNA, 15 bp, Homo sapiens
tgtatgtatgcaaat

SEQ ID NO: 50649 - DNA, 15 bp, Homo sapiens
gtatgtatgcaaatt

SEQ ID NO: 50650 - DNA, 15 bp, Homo sapiens
tatgtatgcaaattt

SEQ ID NO: 50651 - DNA, 15 bp, Homo sapiens
atgtatgcaaatttt

SEQ ID NO: 50652 - DNA, 15 bp, Homo sapiens
tgtatgcaaattttc

SEQ ID NO: 50653 - DNA, 15 bp, Homo sapiens
gtatgcaaattttct

SEQ ID NO: 50654 - DNA, 15 bp, Homo sapiens
tatgcaaattttcta

SEQ ID NO: 50655 - DNA, 15 bp, Homo sapiens
atgcaaattttctat

SEQ ID NO: 50656 - DNA, 15 bp, Homo sapiens
tgcaaattttctatc

SEQ ID NO: 50657 - DNA, 15 bp, Homo sapiens
gcaaattttctatcc

SEQ ID NO: 50658 - DNA, 15 bp, Homo sapiens
caaattttctatccc

SEQ ID NO: 50659 - DNA, 15 bp, Homo sapiens
aaattttctatcccc

SEQ ID NO: 50660 - DNA, 15 bp, Homo sapiens
aattttctatccccc

SEQ ID NO: 50661 - DNA, 15 bp, Homo sapiens
attttctatccccct

SEQ ID NO: 50662 - DNA, 15 bp, Homo sapiens
ttttctatccccctt

SEQ ID NO: 50663 - DNA, 15 bp, Homo sapiens
tttctatcccccttc

SEQ ID NO: 50664 - DNA, 15 bp, Homo sapiens
ttctatcccccttcc

SEQ ID NO: 50665 - DNA, 15 bp, Homo sapiens
tctatcccccttccc

SEQ ID NO: 50666 - DNA, 15 bp, Homo sapiens
ctatcccccttccct

SEQ ID NO: 50667 - DNA, 15 bp, Homo sapiens
tatcccccttccctt

SEQ ID NO: 50668 - DNA, 15 bp, Homo sapiens
atcccccttcccttt

SEQ ID NO: 50669 - DNA, 15 bp, Homo sapiens
tcccccttccctttt

SEQ ID NO: 50670 - DNA, 15 bp, Homo sapiens
cccccttcccttttt

SEQ ID NO: 50671 - DNA, 15 bp, Homo sapiens
ccccttccctttttc

SEQ ID NO: 50672 - DNA, 15 bp, Homo sapiens
cccttccctttttct

SEQ ID NO: 50673 - DNA, 15 bp, Homo sapiens
ccttccctttttctc

SEQ ID NO: 50674 - DNA, 15 bp, Homo sapiens
cttccctttttctct

SEQ ID NO: 50675 - DNA, 15 bp, Homo sapiens
ttccctttttctcta

SEQ ID NO: 50676 - DNA, 15 bp, Homo sapiens
tccctttttctctat

SEQ ID NO: 50677 - DNA, 15 bp, Homo sapiens
ccctttttctctata

SEQ ID NO: 50678 - DNA, 15 bp, Homo sapiens
cctttttctctatag

SEQ ID NO: 50679 - DNA, 15 bp, Homo sapiens
ctttttctctatagc

SEQ ID NO: 50680 - DNA, 15 bp, Homo sapiens
tttttctctatagca

SEQ ID NO: 50681 - DNA, 15 bp, Homo sapiens
ttttctctatagcac

SEQ ID NO: 50682 - DNA, 15 bp, Homo sapiens
tttctctatagcact

SEQ ID NO: 50683 - DNA, 15 bp, Homo sapiens
ttctctatagcactt

SEQ ID NO: 50684 - DNA, 15 bp, Homo sapiens
tctctatagcacttg

SEQ ID NO: 50685 - DNA, 15 bp, Homo sapiens
ctctatagcacttgt

SEQ ID NO: 50686 - DNA, 15 bp, Homo sapiens
tctatagcacttgtg

SEQ ID NO: 50687 - DNA, 15 bp, Homo sapiens
ctatagcacttgtgt

SEQ ID NO: 50688 - DNA, 15 bp, Homo sapiens
tatagcacttgtgtt

SEQ ID NO: 50689 - DNA, 15 bp, Homo sapiens
atagcacttgtgtta

SEQ ID NO: 50690 - DNA, 15 bp, Homo sapiens
tagcacttgtgttac

SEQ ID NO: 50691 - DNA, 15 bp, Homo sapiens
agcacttgtgttact

SEQ ID NO: 50692 - DNA, 15 bp, Homo sapiens
gcacttgtgttactt

SEQ ID NO: 50693 - DNA, 15 bp, Homo sapiens
cacttgtgttacttt

SEQ ID NO: 50694 - DNA, 15 bp, Homo sapiens
acttgtgttactttt

SEQ ID NO: 50695 - DNA, 15 bp, Homo sapiens
cttgtgttacttttg

SEQ ID NO: 50696 - DNA, 15 bp, Homo sapiens
ttgtgttacttttgc

SEQ ID NO: 50697 - DNA, 15 bp, Homo sapiens
tgtgttacttttgca

SEQ ID NO: 50698 - DNA, 15 bp, Homo sapiens
gtgttacttttgcat

SEQ ID NO: 50699 - DNA, 15 bp, Homo sapiens
tgttacttttgcatc

SEQ ID NO: 50700 - DNA, 15 bp, Homo sapiens
gttacttttgcatct

SEQ ID NO: 50701 - DNA, 15 bp, Homo sapiens
ttacttttgcatctt

SEQ ID NO: 50702 - DNA, 15 bp, Homo sapiens
tacttttgcatctta

SEQ ID NO: 50703 - DNA, 15 bp, Homo sapiens
acttttgcatcttag

SEQ ID NO: 50704 - DNA, 15 bp, Homo sapiens
cttttgcatcttagt

SEQ ID NO: 50705 - DNA, 15 bp, Homo sapiens
ttttgcatcttagtc

SEQ ID NO: 50706 - DNA, 15 bp, Homo sapiens
tttgcatcttagtct

SEQ ID NO: 50707 - DNA, 15 bp, Homo sapiens
ttgcatcttagtctg

SEQ ID NO: 50708 - DNA, 15 bp, Homo sapiens
tgcatcttagtctgt

SEQ ID NO: 50709 - DNA, 15 bp, Homo sapiens
gcatcttagtctgtc

SEQ ID NO: 50710 - DNA, 15 bp, Homo sapiens
catcttagtctgtct

SEQ ID NO: 50711 - DNA, 15 bp, Homo sapiens
atcttagtctgtctc

SEQ ID NO: 50712 - DNA, 15 bp, Homo sapiens
tcttagtctgtctct

SEQ ID NO: 50713 - DNA, 15 bp, Homo sapiens
cttagtctgtctctc

SEQ ID NO: 50714 - DNA, 15 bp, Homo sapiens
ttagtctgtctctcc

SEQ ID NO: 50715 - DNA, 15 bp, Homo sapiens
tagtctgtctctccc

SEQ ID NO: 50716 - DNA, 15 bp, Homo sapiens
agtctgtctctccca

SEQ ID NO: 50717 - DNA, 15 bp, Homo sapiens
gtctgtctctcccaa

SEQ ID NO: 50718 - DNA, 15 bp, Homo sapiens
tctgtctctcccaaa

SEQ ID NO: 50719 - DNA, 15 bp, Homo sapiens
ctgtctctcccaaaa

SEQ ID NO: 50720 - DNA, 15 bp, Homo sapiens
tgtctctcccaaaat

SEQ ID NO: 50721 - DNA, 15 bp, Homo sapiens
gtctctcccaaaata

SEQ ID NO: 50722 - DNA, 15 bp, Homo sapiens
tctctcccaaaatag

SEQ ID NO: 50723 - DNA, 15 bp, Homo sapiens
ctctcccaaaatagg

SEQ ID NO: 50724 - DNA, 15 bp, Homo sapiens
tctcccaaaataggg

SEQ ID NO: 50725 - DNA, 15 bp, Homo sapiens
ctcccaaaatagggg

SEQ ID NO: 50726 - DNA, 15 bp, Homo sapiens
tcccaaaatagggga

SEQ ID NO: 50727 - DNA, 15 bp, Homo sapiens
cccaaaataggggac

SEQ ID NO: 50728 - DNA, 15 bp, Homo sapiens
ccaaaataggggaca

SEQ ID NO: 50729 - DNA, 15 bp, Homo sapiens
caaaataggggacaa

SEQ ID NO: 50730 - DNA, 15 bp, Homo sapiens
aaaataggggacaag

SEQ ID NO: 50731 - DNA, 15 bp, Homo sapiens
aaataggggacaagt

SEQ ID NO: 50732 - DNA, 15 bp, Homo sapiens
aataggggacaagtt

SEQ ID NO: 50733 - DNA, 15 bp, Homo sapiens
ataggggacaagttt

SEQ ID NO: 50734 - DNA, 15 bp, Homo sapiens
taggggacaagtttc

SEQ ID NO: 50735 - DNA, 15 bp, Homo sapiens
aggggacaagtttca

SEQ ID NO: 50736 - DNA, 15 bp, Homo sapiens
ggggacaagtttcat

SEQ ID NO: 50737 - DNA, 15 bp, Homo sapiens
gggacaagtttcatg

SEQ ID NO: 50738 - DNA, 15 bp, Homo sapiens
ggacaagtttcatga

SEQ ID NO: 50739 - DNA, 15 bp, Homo sapiens
gacaagtttcatgag

SEQ ID NO: 50740 - DNA, 15 bp, Homo sapiens
acaagtttcatgagg

SEQ ID NO: 50741 - DNA, 15 bp, Homo sapiens
caagtttcatgaggg

SEQ ID NO: 50742 - DNA, 15 bp, Homo sapiens
aagtttcatgagggc

SEQ ID NO: 50743 - DNA, 15 bp, Homo sapiens
agtttcatgagggca

SEQ ID NO: 50744 - DNA, 15 bp, Homo sapiens
gtttcatgagggcaa

SEQ ID NO: 50745 - DNA, 15 bp, Homo sapiens
tttcatgagggcaaa

SEQ ID NO: 50746 - DNA, 15 bp, Homo sapiens
ttcatgagggcaaaa

SEQ ID NO: 50747 - DNA, 15 bp, Homo sapiens
tcatgagggcaaaaa

SEQ ID NO: 50748 - DNA, 15 bp, Homo sapiens
catgagggcaaaaac

SEQ ID NO: 50749 - DNA, 15 bp, Homo sapiens
atgagggcaaaaacc

SEQ ID NO: 50750 - DNA, 15 bp, Homo sapiens
tgagggcaaaaacct

SEQ ID NO: 50751 - DNA, 15 bp, Homo sapiens
gagggcaaaaacctg

SEQ ID NO: 50752 - DNA, 15 bp, Homo sapiens
agggcaaaaacctgt

SEQ ID NO: 50753 - DNA, 15 bp, Homo sapiens
gggcaaaaacctgtc

SEQ ID NO: 50754 - DNA, 15 bp, Homo sapiens
ggcaaaaacctgtct

SEQ ID NO: 50755 - DNA, 15 bp, Homo sapiens
gcaaaaacctgtctg

SEQ ID NO: 50756 - DNA, 15 bp, Homo sapiens
caaaaacctgtctgt

SEQ ID NO: 50757 - DNA, 15 bp, Homo sapiens
aaaaacctgtctgtt

SEQ ID NO: 50758 - DNA, 15 bp, Homo sapiens
aaaacctgtctgttt

SEQ ID NO: 50759 - DNA, 15 bp, Homo sapiens
aaacctgtctgtttt

SEQ ID NO: 50760 - DNA, 15 bp, Homo sapiens
aacctgtctgttttg

SEQ ID NO: 50761 - DNA, 15 bp, Homo sapiens
acctgtctgttttgt

SEQ ID NO: 50762 - DNA, 15 bp, Homo sapiens
cctgtctgttttgtt

SEQ ID NO: 50763 - DNA, 15 bp, Homo sapiens
ctgtctgttttgttt

SEQ ID NO: 50764 - DNA, 15 bp, Homo sapiens
tgtctgttttgttta

SEQ ID NO: 50765 - DNA, 15 bp, Homo sapiens
gtctgttttgtttat

SEQ ID NO: 50766 - DNA, 15 bp, Homo sapiens
tctgttttgtttatt

SEQ ID NO: 50767 - DNA, 15 bp, Homo sapiens
ctgttttgtttattg

SEQ ID NO: 50768 - DNA, 15 bp, Homo sapiens
tgttttgtttattgc

SEQ ID NO: 50769 - DNA, 15 bp, Homo sapiens
gttttgtttattgct

SEQ ID NO: 50770 - DNA, 15 bp, Homo sapiens
ttttgtttattgcta

SEQ ID NO: 50771 - DNA, 15 bp, Homo sapiens
tttgtttattgctat

SEQ ID NO: 50772 - DNA, 15 bp, Homo sapiens
ttgtttattgctata

SEQ ID NO: 50773 - DNA, 15 bp, Homo sapiens
tgtttattgctatat

SEQ ID NO: 50774 - DNA, 15 bp, Homo sapiens
gtttattgctatatt

SEQ ID NO: 50775 - DNA, 15 bp, Homo sapiens
tttattgctatattc

SEQ ID NO: 50776 - DNA, 15 bp, Homo sapiens
ttattgctatattcc

SEQ ID NO: 50777 - DNA, 15 bp, Homo sapiens
tattgctatattcct

SEQ ID NO: 50778 - DNA, 15 bp, Homo sapiens
attgctatattccta

SEQ ID NO: 50779 - DNA, 15 bp, Homo sapiens
ttgctatattcctag

SEQ ID NO: 50780 - DNA, 15 bp, Homo sapiens
tgctatattcctagc

SEQ ID NO: 50781 - DNA, 15 bp, Homo sapiens
gctatattcctagca

SEQ ID NO: 50782 - DNA, 15 bp, Homo sapiens
ctatattcctagcat

SEQ ID NO: 50783 - DNA, 15 bp, Homo sapiens
tatattcctagcatc

SEQ ID NO: 50784 - DNA, 15 bp, Homo sapiens
atattcctagcatct

SEQ ID NO: 50785 - DNA, 15 bp, Homo sapiens
tattcctagcatctg

SEQ ID NO: 50786 - DNA, 15 bp, Homo sapiens
attcctagcatctgt

SEQ ID NO: 50787 - DNA, 15 bp, Homo sapiens
ttcctagcatctgtc

SEQ ID NO: 50788 - DNA, 15 bp, Homo sapiens
tcctagcatctgtca

SEQ ID NO: 50789 - DNA, 15 bp, Homo sapiens
cctagcatctgtcat

SEQ ID NO: 50790 - DNA, 15 bp, Homo sapiens
ctagcatctgtcatg

SEQ ID NO: 50791 - DNA, 15 bp, Homo sapiens
tagcatctgtcatgt

SEQ ID NO: 50792 - DNA, 15 bp, Homo sapiens
agcatctgtcatgta

SEQ ID NO: 50793 - DNA, 15 bp, Homo sapiens
gcatctgtcatgtaa

SEQ ID NO: 50794 - DNA, 15 bp, Homo sapiens
catctgtcatgtaat

SEQ ID NO: 50795 - DNA, 15 bp, Homo sapiens
atctgtcatgtaata

SEQ ID NO: 50796 - DNA, 15 bp, Homo sapiens
tctgtcatgtaatag

SEQ ID NO: 50797 - DNA, 15 bp, Homo sapiens
ctgtcatgtaatagg

SEQ ID NO: 50798 - DNA, 15 bp, Homo sapiens
tgtcatgtaataggt

SEQ ID NO: 50799 - DNA, 15 bp, Homo sapiens
gtcatgtaataggtg

SEQ ID NO: 50800 - DNA, 15 bp, Homo sapiens
tcatgtaataggtgt

SEQ ID NO: 50801 - DNA, 15 bp, Homo sapiens
catgtaataggtgtg

SEQ ID NO: 50802 - DNA, 15 bp, Homo sapiens
atgtaataggtgtgc

SEQ ID NO: 50803 - DNA, 15 bp, Homo sapiens
tgtaataggtgtgct

SEQ ID NO: 50804 - DNA, 15 bp, Homo sapiens
gtaataggtgtgctt

SEQ ID NO: 50805 - DNA, 15 bp, Homo sapiens
taataggtgtgctta

SEQ ID NO: 50806 - DNA, 15 bp, Homo sapiens
aataggtgtgcttac

SEQ ID NO: 50807 - DNA, 15 bp, Homo sapiens
ataggtgtgcttact

SEQ ID NO: 50808 - DNA, 15 bp, Homo sapiens
taggtgtgcttactg

SEQ ID NO: 50809 - DNA, 15 bp, Homo sapiens
aggtgtgcttactgc

SEQ ID NO: 50810 - DNA, 15 bp, Homo sapiens
ggtgtgcttactgct

SEQ ID NO: 50811 - DNA, 15 bp, Homo sapiens
gtgtgcttactgctt

SEQ ID NO: 50812 - DNA, 15 bp, Homo sapiens
tgtgcttactgcttg

SEQ ID NO: 50813 - DNA, 15 bp, Homo sapiens
gtgcttactgcttgt

SEQ ID NO: 50814 - DNA, 15 bp, Homo sapiens
tgcttactgcttgtt

SEQ ID NO: 50815 - DNA, 15 bp, Homo sapiens
gcttactgcttgtta

SEQ ID NO: 50816 - DNA, 15 bp, Homo sapiens
cttactgcttgttag

SEQ ID NO: 50817 - DNA, 15 bp, Homo sapiens
ttactgcttgttagg

SEQ ID NO: 50818 - DNA, 15 bp, Homo sapiens
tactgcttgttaggt

SEQ ID NO: 50819 - DNA, 15 bp, Homo sapiens
actgcttgttaggta

SEQ ID NO: 50820 - DNA, 15 bp, Homo sapiens
ctgcttgttaggtaa

SEQ ID NO: 50821 - DNA, 15 bp, Homo sapiens
tgcttgttaggtaaa

SEQ ID NO: 50822 - DNA, 15 bp, Homo sapiens
gcttgttaggtaaaa

SEQ ID NO: 50823 - DNA, 15 bp, Homo sapiens
cttgttaggtaaaaa

SEQ ID NO: 50824 - DNA, 15 bp, Homo sapiens
ttgttaggtaaaaaa

SEQ ID NO: 50825 - DNA, 15 bp, Homo sapiens
tgttaggtaaaaaag

SEQ ID NO: 50826 - DNA, 15 bp, Homo sapiens
gttaggtaaaaaagt

SEQ ID NO: 50827 - DNA, 15 bp, Homo sapiens
ttaggtaaaaaagtt

SEQ ID NO: 50828 - DNA, 15 bp, Homo sapiens
taggtaaaaaagttc

SEQ ID NO: 50829 - DNA, 15 bp, Homo sapiens
aggtaaaaaagttca

SEQ ID NO: 50830 - DNA, 15 bp, Homo sapiens
ggtaaaaaagttcag

SEQ ID NO: 50831 - DNA, 15 bp, Homo sapiens
gtaaaaaagttcaga

SEQ ID NO: 50832 - DNA, 15 bp, Homo sapiens
taaaaaagttcagaa

SEQ ID NO: 50833 - DNA, 15 bp, Homo sapiens
aaaaaagttcagaaa

SEQ ID NO: 50834 - DNA, 15 bp, Homo sapiens
aaaaagttcagaaat

SEQ ID NO: 50835 - DNA, 15 bp, Homo sapiens
aaaagttcagaaatt

SEQ ID NO: 50836 - DNA, 15 bp, Homo sapiens
aaagttcagaaattg

SEQ ID NO: 50837 - DNA, 15 bp, Homo sapiens
aagttcagaaattgc

SEQ ID NO: 50838 - DNA, 15 bp, Homo sapiens
agttcagaaattgcc

SEQ ID NO: 50839 - DNA, 15 bp, Homo sapiens
gttcagaaattgcca

SEQ ID NO: 50840 - DNA, 15 bp, Homo sapiens
ttcagaaattgccac

SEQ ID NO: 50841 - DNA, 15 bp, Homo sapiens
tcagaaattgccacc

SEQ ID NO: 50842 - DNA, 15 bp, Homo sapiens
cagaaattgccaccc

SEQ ID NO: 50843 - DNA, 15 bp, Homo sapiens
agaaattgccaccca

SEQ ID NO: 50844 - DNA, 15 bp, Homo sapiens
gaaattgccacccag

SEQ ID NO: 50845 - DNA, 15 bp, Homo sapiens
aaattgccacccagt

SEQ ID NO: 50846 - DNA, 15 bp, Homo sapiens
aattgccacccagta

SEQ ID NO: 50847 - DNA, 15 bp, Homo sapiens
attgccacccagtag

SEQ ID NO: 50848 - DNA, 15 bp, Homo sapiens
ttgccacccagtagt

SEQ ID NO: 50849 - DNA, 15 bp, Homo sapiens
tgccacccagtagta

SEQ ID NO: 50850 - DNA, 15 bp, Homo sapiens
gccacccagtagtat

SEQ ID NO: 50851 - DNA, 15 bp, Homo sapiens
ccacccagtagtatc

SEQ ID NO: 50852 - DNA, 15 bp, Homo sapiens
cacccagtagtatcc

SEQ ID NO: 50853 - DNA, 15 bp, Homo sapiens
acccagtagtatcca

SEQ ID NO: 50854 - DNA, 15 bp, Homo sapiens
cccagtagtatccat

SEQ ID NO: 50855 - DNA, 15 bp, Homo sapiens
ccagtagtatccata

SEQ ID NO: 50856 - DNA, 15 bp, Homo sapiens
cagtagtatccatat

SEQ ID NO: 50857 - DNA, 15 bp, Homo sapiens
agtagtatccatatt

SEQ ID NO: 50858 - DNA, 15 bp, Homo sapiens
gtagtatccatattt

SEQ ID NO: 50859 - DNA, 15 bp, Homo sapiens
tagtatccatatttg

SEQ ID NO: 50860 - DNA, 15 bp, Homo sapiens
agtatccatatttgt

SEQ ID NO: 50861 - DNA, 15 bp, Homo sapiens
gtatccatatttgtt

SEQ ID NO: 50862 - DNA, 15 bp, Homo sapiens
tatccatatttgttc

SEQ ID NO: 50863 - DNA, 15 bp, Homo sapiens
atccatatttgttcc

SEQ ID NO: 50864 - DNA, 15 bp, Homo sapiens
tccatatttgttccc

SEQ ID NO: 50865 - DNA, 15 bp, Homo sapiens
ccatatttgttccct

SEQ ID NO: 50866 - DNA, 15 bp, Homo sapiens
catatttgttccctt

SEQ ID NO: 50867 - DNA, 15 bp, Homo sapiens
atatttgttcccttt

SEQ ID NO: 50868 - DNA, 15 bp, Homo sapiens
tatttgttccctttg

SEQ ID NO: 50869 - DNA, 15 bp, Homo sapiens
atttgttccctttgt

SEQ ID NO: 50870 - DNA, 15 bp, Homo sapiens
tttgttccctttgta

SEQ ID NO: 50871 - DNA, 15 bp, Homo sapiens
ttgttccctttgtag

SEQ ID NO: 50872 - DNA, 15 bp, Homo sapiens
tgttccctttgtagg

SEQ ID NO: 50873 - DNA, 15 bp, Homo sapiens
gttccctttgtaggt

SEQ ID NO: 50874 - DNA, 15 bp, Homo sapiens
ttccctttgtaggtc

SEQ ID NO: 50875 - DNA, 15 bp, Homo sapiens
tccctttgtaggtca

SEQ ID NO: 50876 - DNA, 15 bp, Homo sapiens
ccctttgtaggtcat

SEQ ID NO: 50877 - DNA, 15 bp, Homo sapiens
cctttgtaggtcatt

SEQ ID NO: 50878 - DNA, 15 bp, Homo sapiens
ctttgtaggtcatta

SEQ ID NO: 50879 - DNA, 15 bp, Homo sapiens
tttgtaggtcattaa

SEQ ID NO: 50880 - DNA, 15 bp, Homo sapiens
ttgtaggtcattaaa

SEQ ID NO: 50881 - DNA, 15 bp, Homo sapiens
tgtaggtcattaaac

SEQ ID NO: 50882 - DNA, 15 bp, Homo sapiens
gtaggtcattaaaca

SEQ ID NO: 50883 - DNA, 15 bp, Homo sapiens
taggtcattaaacag

SEQ ID NO: 50884 - DNA, 15 bp, Homo sapiens
aggtcattaaacagc

SEQ ID NO: 50885 - DNA, 15 bp, Homo sapiens
ggtcattaaacagct

SEQ ID NO: 50886 - DNA, 15 bp, Homo sapiens
gtcattaaacagctg

SEQ ID NO: 50887 - DNA, 15 bp, Homo sapiens
tcattaaacagctga

SEQ ID NO: 50888 - DNA, 15 bp, Homo sapiens
cattaaacagctgat

SEQ ID NO: 50889 - DNA, 15 bp, Homo sapiens
attaaacagctgatg

SEQ ID NO: 50890 - DNA, 15 bp, Homo sapiens
ttaaacagctgatga

SEQ ID NO: 50891 - DNA, 15 bp, Homo sapiens
taaacagctgatgaa

SEQ ID NO: 50892 - DNA, 15 bp, Homo sapiens
aaacagctgatgaaa

SEQ ID NO: 50893 - DNA, 15 bp, Homo sapiens
aacagctgatgaaaa

SEQ ID NO: 50894 - DNA, 15 bp, Homo sapiens
acagctgatgaaaaa

SEQ ID NO: 50895 - DNA, 15 bp, Homo sapiens
cagctgatgaaaaag

SEQ ID NO: 50896 - DNA, 15 bp, Homo sapiens
agctgatgaaaaagg

SEQ ID NO: 50897 - DNA, 15 bp, Homo sapiens
gctgatgaaaaagga

SEQ ID NO: 50898 - DNA, 15 bp, Homo sapiens
ctgatgaaaaaggaa

SEQ ID NO: 50899 - DNA, 15 bp, Homo sapiens
tgatgaaaaaggaat

SEQ ID NO: 50900 - DNA, 15 bp, Homo sapiens
gatgaaaaaggaatt

SEQ ID NO: 50901 - DNA, 15 bp, Homo sapiens
atgaaaaaggaattc

SEQ ID NO: 50902 - DNA, 15 bp, Homo sapiens
tgaaaaaggaattca

SEQ ID NO: 50903 - DNA, 15 bp, Homo sapiens
gaaaaaggaattcac

SEQ ID NO: 50904 - DNA, 15 bp, Homo sapiens
aaaaaggaattcact

SEQ ID NO: 50905 - DNA, 15 bp, Homo sapiens
aaaaggaattcactc

SEQ ID NO: 50906 - DNA, 15 bp, Homo sapiens
aaaggaattcactct

SEQ ID NO: 50907 - DNA, 15 bp, Homo sapiens
aaggaattcactcta

SEQ ID NO: 50908 - DNA, 15 bp, Homo sapiens
aggaattcactctag

SEQ ID NO: 50909 - DNA, 15 bp, Homo sapiens
ggaattcactctaga

SEQ ID NO: 50910 - DNA, 15 bp, Homo sapiens
gaattcactctagag

SEQ ID NO: 50911 - DNA, 15 bp, Homo sapiens
aattcactctagagt

SEQ ID NO: 50912 - DNA, 15 bp, Homo sapiens
attcactctagagtt

SEQ ID NO: 50913 - DNA, 15 bp, Homo sapiens
ttcactctagagttt

SEQ ID NO: 50914 - DNA, 15 bp, Homo sapiens
tcactctagagtttt

SEQ ID NO: 50915 - DNA, 15 bp, Homo sapiens
cactctagagttttc

SEQ ID NO: 50916 - DNA, 15 bp, Homo sapiens
actctagagttttca

SEQ ID NO: 50917 - DNA, 15 bp, Homo sapiens
ctctagagttttcac

SEQ ID NO: 50918 - DNA, 15 bp, Homo sapiens
tctagagttttcacg

SEQ ID NO: 50919 - DNA, 15 bp, Homo sapiens
ctagagttttcacgt

SEQ ID NO: 50920 - DNA, 15 bp, Homo sapiens
tagagttttcacgtg

SEQ ID NO: 50921 - DNA, 15 bp, Homo sapiens
agagttttcacgtga

SEQ ID NO: 50922 - DNA, 15 bp, Homo sapiens
gagttttcacgtgac

SEQ ID NO: 50923 - DNA, 15 bp, Homo sapiens
agttttcacgtgaca

SEQ ID NO: 50924 - DNA, 15 bp, Homo sapiens
gttttcacgtgacag

SEQ ID NO: 50925 - DNA, 15 bp, Homo sapiens
ttttcacgtgacaga

SEQ ID NO: 50926 - DNA, 15 bp, Homo sapiens
tttcacgtgacagaa

SEQ ID NO: 50927 - DNA, 15 bp, Homo sapiens
ttcacgtgacagaaa

SEQ ID NO: 50928 - DNA, 15 bp, Homo sapiens
tcacgtgacagaaag

SEQ ID NO: 50929 - DNA, 15 bp, Homo sapiens
cacgtgacagaaagt

SEQ ID NO: 50930 - DNA, 15 bp, Homo sapiens
acgtgacagaaagtc

SEQ ID NO: 50931 - DNA, 15 bp, Homo sapiens
cgtgacagaaagtca

SEQ ID NO: 50932 - DNA, 15 bp, Homo sapiens
gtgacagaaagtcaa

SEQ ID NO: 50933 - DNA, 15 bp, Homo sapiens
tgacagaaagtcaat

SEQ ID NO: 50934 - DNA, 15 bp, Homo sapiens
gacagaaagtcaatg

SEQ ID NO: 50935 - DNA, 15 bp, Homo sapiens
acagaaagtcaatgt

SEQ ID NO: 50936 - DNA, 15 bp, Homo sapiens
cagaaagtcaatgtc

SEQ ID NO: 50937 - DNA, 15 bp, Homo sapiens
agaaagtcaatgtcg

SEQ ID NO: 50938 - DNA, 15 bp, Homo sapiens
gaaagtcaatgtcgg

SEQ ID NO: 50939 - DNA, 15 bp, Homo sapiens
aaagtcaatgtcggt

SEQ ID NO: 50940 - DNA, 15 bp, Homo sapiens
aagtcaatgtcggtt

SEQ ID NO: 50941 - DNA, 15 bp, Homo sapiens
agtcaatgtcggttt

SEQ ID NO: 50942 - DNA, 15 bp, Homo sapiens
gtcaatgtcggttta

SEQ ID NO: 50943 - DNA, 15 bp, Homo sapiens
tcaatgtcggtttac

SEQ ID NO: 50944 - DNA, 15 bp, Homo sapiens
caatgtcggtttact

SEQ ID NO: 50945 - DNA, 15 bp, Homo sapiens
aatgtcggtttactg

SEQ ID NO: 50946 - DNA, 15 bp, Homo sapiens
atgtcggtttactgt

SEQ ID NO: 50947 - DNA, 15 bp, Homo sapiens
tgtcggtttactgta

SEQ ID NO: 50948 - DNA, 15 bp, Homo sapiens
gtcggtttactgtac

SEQ ID NO: 50949 - DNA, 15 bp, Homo sapiens
tcggtttactgtaca

SEQ ID NO: 50950 - DNA, 15 bp, Homo sapiens
cggtttactgtacac

SEQ ID NO: 50951 - DNA, 15 bp, Homo sapiens
ggtttactgtacacc

SEQ ID NO: 50952 - DNA, 15 bp, Homo sapiens
gtttactgtacacca

SEQ ID NO: 50953 - DNA, 15 bp, Homo sapiens
tttactgtacaccaa

SEQ ID NO: 50954 - DNA, 15 bp, Homo sapiens
ttactgtacaccaaa

SEQ ID NO: 50955 - DNA, 15 bp, Homo sapiens
tactgtacaccaaat

SEQ ID NO: 50956 - DNA, 15 bp, Homo sapiens
actgtacaccaaata

SEQ ID NO: 50957 - DNA, 15 bp, Homo sapiens
ctgtacaccaaataa

SEQ ID NO: 50958 - DNA, 15 bp, Homo sapiens
tgtacaccaaataaa

SEQ ID NO: 50959 - DNA, 15 bp, Homo sapiens
gtacaccaaataaac

SEQ ID NO: 50960 - DNA, 15 bp, Homo sapiens
tacaccaaataaacc

SEQ ID NO: 50961 - DNA, 15 bp, Homo sapiens
acaccaaataaacca

SEQ ID NO: 50962 - DNA, 15 bp, Homo sapiens
caccaaataaaccaa

SEQ ID NO: 50963 - DNA, 15 bp, Homo sapiens
accaaataaaccaag

SEQ ID NO: 50964 - DNA, 15 bp, Homo sapiens
ccaaataaaccaagc

SEQ ID NO: 50965 - DNA, 15 bp, Homo sapiens
caaataaaccaagca

SEQ ID NO: 50966 - DNA, 15 bp, Homo sapiens
aaataaaccaagcag

SEQ ID NO: 50967 - DNA, 15 bp, Homo sapiens
aataaaccaagcagg

SEQ ID NO: 50968 - DNA, 15 bp, Homo sapiens
ataaaccaagcagga

SEQ ID NO: 50969 - DNA, 15 bp, Homo sapiens
taaaccaagcaggac

SEQ ID NO: 50970 - DNA, 15 bp, Homo sapiens
aaaccaagcaggaca

SEQ ID NO: 50971 - DNA, 15 bp, Homo sapiens
aaccaagcaggacat

SEQ ID NO: 50972 - DNA, 15 bp, Homo sapiens
accaagcaggacatc

SEQ ID NO: 50973 - DNA, 15 bp, Homo sapiens
ccaagcaggacatca

SEQ ID NO: 50974 - DNA, 15 bp, Homo sapiens
caagcaggacatcaa

SEQ ID NO: 50975 - DNA, 15 bp, Homo sapiens
aagcaggacatcaat

SEQ ID NO: 50976 - DNA, 15 bp, Homo sapiens
agcaggacatcaatg

SEQ ID NO: 50977 - DNA, 15 bp, Homo sapiens
gcaggacatcaatga

SEQ ID NO: 50978 - DNA, 15 bp, Homo sapiens
caggacatcaatgag

SEQ ID NO: 50979 - DNA, 15 bp, Homo sapiens
aggacatcaatgagc

SEQ ID NO: 50980 - DNA, 15 bp, Homo sapiens
ggacatcaatgagca

SEQ ID NO: 50981 - DNA, 15 bp, Homo sapiens
gacatcaatgagcaa

SEQ ID NO: 50982 - DNA, 15 bp, Homo sapiens
acatcaatgagcaag

SEQ ID NO: 50983 - DNA, 15 bp, Homo sapiens
catcaatgagcaaga

SEQ ID NO: 50984 - DNA, 15 bp, Homo sapiens
atcaatgagcaagat

SEQ ID NO: 50985 - DNA, 15 bp, Homo sapiens
tcaatgagcaagatg

SEQ ID NO: 50986 - DNA, 15 bp, Homo sapiens
caatgagcaagatgt

SEQ ID NO: 50987 - DNA, 15 bp, Homo sapiens
aatgagcaagatgtt

SEQ ID NO: 50988 - DNA, 15 bp, Homo sapiens
atgagcaagatgttt

SEQ ID NO: 50989 - DNA, 15 bp, Homo sapiens
tgagcaagatgtttg

SEQ ID NO: 50990 - DNA, 15 bp, Homo sapiens
gagcaagatgtttgt

SEQ ID NO: 50991 - DNA, 15 bp, Homo sapiens
agcaagatgtttgtg

SEQ ID NO: 50992 - DNA, 15 bp, Homo sapiens
gcaagatgtttgtga

SEQ ID NO: 50993 - DNA, 15 bp, Homo sapiens
caagatgtttgtgaa

SEQ ID NO: 50994 - DNA, 15 bp, Homo sapiens
aagatgtttgtgaag

SEQ ID NO: 50995 - DNA, 15 bp, Homo sapiens
agatgtttgtgaagg

SEQ ID NO: 50996 - DNA, 15 bp, Homo sapiens
gatgtttgtgaaggc

SEQ ID NO: 50997 - DNA, 15 bp, Homo sapiens
atgtttgtgaaggca

SEQ ID NO: 50998 - DNA, 15 bp, Homo sapiens
tgtttgtgaaggcaa

SEQ ID NO: 50999 - DNA, 15 bp, Homo sapiens
gtttgtgaaggcaag

SEQ ID NO: 51000 - DNA, 15 bp, Homo sapiens
tttgtgaaggcaagt

SEQ ID NO: 51001 - DNA, 15 bp, Homo sapiens
ttgtgaaggcaagta

SEQ ID NO: 51002 - DNA, 15 bp, Homo sapiens
tgtgaaggcaagtat

SEQ ID NO: 51003 - DNA, 15 bp, Homo sapiens
gtgaaggcaagtatg

SEQ ID NO: 51004 - DNA, 15 bp, Homo sapiens
tgaaggcaagtatgg

SEQ ID NO: 51005 - DNA, 15 bp, Homo sapiens
gaaggcaagtatggc

SEQ ID NO: 51006 - DNA, 15 bp, Homo sapiens
aaggcaagtatggca

SEQ ID NO: 51007 - DNA, 15 bp, Homo sapiens
aggcaagtatggcag

SEQ ID NO: 51008 - DNA, 15 bp, Homo sapiens
ggcaagtatggcaga

SEQ ID NO: 51009 - DNA, 15 bp, Homo sapiens
gcaagtatggcagat

SEQ ID NO: 51010 - DNA, 15 bp, Homo sapiens
caagtatggcagatt

SEQ ID NO: 51011 - DNA, 15 bp, Homo sapiens
aagtatggcagattg

SEQ ID NO: 51012 - DNA, 15 bp, Homo sapiens
agtatggcagattgc

SEQ ID NO: 51013 - DNA, 15 bp, Homo sapiens
gtatggcagattgca

SEQ ID NO: 51014 - DNA, 15 bp, Homo sapiens
tatggcagattgcaa

SEQ ID NO: 51015 - DNA, 15 bp, Homo sapiens
atggcagattgcaat

SEQ ID NO: 51016 - DNA, 15 bp, Homo sapiens
tggcagattgcaatt

SEQ ID NO: 51017 - DNA, 15 bp, Homo sapiens
ggcagattgcaattg

SEQ ID NO: 51018 - DNA, 15 bp, Homo sapiens
gcagattgcaattga

SEQ ID NO: 51019 - DNA, 15 bp, Homo sapiens
cagattgcaattgag

SEQ ID NO: 51020 - DNA, 15 bp, Homo sapiens
agattgcaattgaga

SEQ ID NO: 51021 - DNA, 15 bp, Homo sapiens
gattgcaattgagat

SEQ ID NO: 51022 - DNA, 15 bp, Homo sapiens
attgcaattgagatg

SEQ ID NO: 51023 - DNA, 15 bp, Homo sapiens
ttgcaattgagatgt

SEQ ID NO: 51024 - DNA, 15 bp, Homo sapiens
tgcaattgagatgtt

SEQ ID NO: 51025 - DNA, 15 bp, Homo sapiens
gcaattgagatgttc

SEQ ID NO: 51026 - DNA, 15 bp, Homo sapiens
caattgagatgttct

SEQ ID NO: 51027 - DNA, 15 bp, Homo sapiens
aattgagatgttctt

SEQ ID NO: 51028 - DNA, 15 bp, Homo sapiens
attgagatgttcttg

SEQ ID NO: 51029 - DNA, 15 bp, Homo sapiens
ttgagatgttcttgc

SEQ ID NO: 51030 - DNA, 15 bp, Homo sapiens
tgagatgttcttgcc

SEQ ID NO: 51031 - DNA, 15 bp, Homo sapiens
gagatgttcttgcca

SEQ ID NO: 51032 - DNA, 15 bp, Homo sapiens
agatgttcttgccag

SEQ ID NO: 51033 - DNA, 15 bp, Homo sapiens
gatgttcttgccagg

SEQ ID NO: 51034 - DNA, 15 bp, Homo sapiens
atgttcttgccaggg

SEQ ID NO: 51035 - DNA, 15 bp, Homo sapiens
tgttcttgccagggt

SEQ ID NO: 51036 - DNA, 15 bp, Homo sapiens
gttcttgccagggtt

SEQ ID NO: 51037 - DNA, 15 bp, Homo sapiens
ttcttgccagggtta

SEQ ID NO: 51038 - DNA, 15 bp, Homo sapiens
tcttgccagggttaa

SEQ ID NO: 51039 - DNA, 15 bp, Homo sapiens
cttgccagggttaag

SEQ ID NO: 51040 - DNA, 15 bp, Homo sapiens
ttgccagggttaaga

SEQ ID NO: 51041 - DNA, 15 bp, Homo sapiens
tgccagggttaagat

SEQ ID NO: 51042 - DNA, 15 bp, Homo sapiens
gccagggttaagatc

SEQ ID NO: 51043 - DNA, 15 bp, Homo sapiens
ccagggttaagatcc

SEQ ID NO: 51044 - DNA, 15 bp, Homo sapiens
cagggttaagatccc

SEQ ID NO: 51045 - DNA, 15 bp, Homo sapiens
agggttaagatcccg

SEQ ID NO: 51046 - DNA, 15 bp, Homo sapiens
gggttaagatcccgg

SEQ ID NO: 51047 - DNA, 15 bp, Homo sapiens
ggttaagatcccggt

SEQ ID NO: 51048 - DNA, 15 bp, Homo sapiens
gttaagatcccggtg

SEQ ID NO: 51049 - DNA, 15 bp, Homo sapiens
ttaagatcccggtga

SEQ ID NO: 51050 - DNA, 15 bp, Homo sapiens
taagatcccggtgaa

SEQ ID NO: 51051 - DNA, 15 bp, Homo sapiens
aagatcccggtgaac

SEQ ID NO: 51052 - DNA, 15 bp, Homo sapiens
agatcccggtgaacc

SEQ ID NO: 51053 - DNA, 15 bp, Homo sapiens
gatcccggtgaacca

SEQ ID NO: 51054 - DNA, 15 bp, Homo sapiens
atcccggtgaaccaa

SEQ ID NO: 51055 - DNA, 15 bp, Homo sapiens
tcccggtgaaccaat

SEQ ID NO: 51056 - DNA, 15 bp, Homo sapiens
cccggtgaaccaata

SEQ ID NO: 51057 - DNA, 15 bp, Homo sapiens
ccggtgaaccaataa

SEQ ID NO: 51058 - DNA, 15 bp, Homo sapiens
cggtgaaccaataaa

SEQ ID NO: 51059 - DNA, 15 bp, Homo sapiens
ggtgaaccaataaaa

SEQ ID NO: 51060 - DNA, 15 bp, Homo sapiens
gtgaaccaataaaac

SEQ ID NO: 51061 - DNA, 15 bp, Homo sapiens
tgaaccaataaaaca

SEQ ID NO: 51062 - DNA, 15 bp, Homo sapiens
gaaccaataaaacaa

SEQ ID NO: 51063 - DNA, 15 bp, Homo sapiens
aaccaataaaacaaa

SEQ ID NO: 51064 - DNA, 15 bp, Homo sapiens
accaataaaacaaaa

SEQ ID NO: 51065 - DNA, 15 bp, Homo sapiens
ccaataaaacaaaat

SEQ ID NO: 51066 - DNA, 15 bp, Homo sapiens
caataaaacaaaatt

SEQ ID NO: 51067 - DNA, 15 bp, Homo sapiens
aataaaacaaaattg

SEQ ID NO: 51068 - DNA, 15 bp, Homo sapiens
ataaaacaaaattgt

SEQ ID NO: 51069 - DNA, 15 bp, Homo sapiens
taaaacaaaattgtt

SEQ ID NO: 51070 - DNA, 15 bp, Homo sapiens
aaaacaaaattgttt

SEQ ID NO: 51071 - DNA, 15 bp, Homo sapiens
aaacaaaattgttta

SEQ ID NO: 51072 - DNA, 15 bp, Homo sapiens
aacaaaattgtttat

SEQ ID NO: 51073 - DNA, 15 bp, Homo sapiens
acaaaattgtttatc

SEQ ID NO: 51074 - DNA, 15 bp, Homo sapiens
caaaattgtttatct

SEQ ID NO: 51075 - DNA, 15 bp, Homo sapiens
aaaattgtttatcta

SEQ ID NO: 51076 - DNA, 15 bp, Homo sapiens
aaattgtttatctaa

SEQ ID NO: 51077 - DNA, 15 bp, Homo sapiens
aattgtttatctaaa

SEQ ID NO: 51078 - DNA, 15 bp, Homo sapiens
attgtttatctaaat

SEQ ID NO: 51079 - DNA, 15 bp, Homo sapiens
ttgtttatctaaatc

SEQ ID NO: 51080 - DNA, 15 bp, Homo sapiens
tgtttatctaaatct

SEQ ID NO: 51081 - DNA, 15 bp, Homo sapiens
gtttatctaaatctg

SEQ ID NO: 51082 - DNA, 15 bp, Homo sapiens
tttatctaaatctgt

SEQ ID NO: 51083 - DNA, 15 bp, Homo sapiens
ttatctaaatctgta

SEQ ID NO: 51084 - DNA, 15 bp, Homo sapiens
tatctaaatctgtaa

SEQ ID NO: 51085 - DNA, 15 bp, Homo sapiens
atctaaatctgtaac

SEQ ID NO: 51086 - DNA, 15 bp, Homo sapiens
tctaaatctgtaaca

SEQ ID NO: 51087 - DNA, 15 bp, Homo sapiens
ctaaatctgtaacat

SEQ ID NO: 51088 - DNA, 15 bp, Homo sapiens
taaatctgtaacatt

SEQ ID NO: 51089 - DNA, 15 bp, Homo sapiens
aaatctgtaacattt

SEQ ID NO: 51090 - DNA, 15 bp, Homo sapiens
aatctgtaacatttc

SEQ ID NO: 51091 - DNA, 15 bp, Homo sapiens
atctgtaacatttcc

SEQ ID NO: 51092 - DNA, 15 bp, Homo sapiens
tctgtaacatttcca

SEQ ID NO: 51093 - DNA, 15 bp, Homo sapiens
ctgtaacatttccag

SEQ ID NO: 51094 - DNA, 15 bp, Homo sapiens
tgtaacatttccagg

SEQ ID NO: 51095 - DNA, 15 bp, Homo sapiens
gtaacatttccaggg

SEQ ID NO: 51096 - DNA, 15 bp, Homo sapiens
taacatttccagggt

SEQ ID NO: 51097 - DNA, 15 bp, Homo sapiens
aacatttccagggtg

SEQ ID NO: 51098 - DNA, 15 bp, Homo sapiens
acatttccagggtgc

SEQ ID NO: 51099 - DNA, 15 bp, Homo sapiens
catttccagggtgct

SEQ ID NO: 51100 - DNA, 15 bp, Homo sapiens
atttccagggtgctc

SEQ ID NO: 51101 - DNA, 15 bp, Homo sapiens
tttccagggtgctcc

SEQ ID NO: 51102 - DNA, 15 bp, Homo sapiens
ttccagggtgctcct

SEQ ID NO: 51103 - DNA, 15 bp, Homo sapiens
tccagggtgctcctg

SEQ ID NO: 51104 - DNA, 15 bp, Homo sapiens
ccagggtgctcctga

SEQ ID NO: 51105 - DNA, 15 bp, Homo sapiens
cagggtgctcctgaa

SEQ ID NO: 51106 - DNA, 15 bp, Homo sapiens
agggtgctcctgaag

SEQ ID NO: 51107 - DNA, 15 bp, Homo sapiens
gggtgctcctgaagg

SEQ ID NO: 51108 - DNA, 15 bp, Homo sapiens
ggtgctcctgaaggt

SEQ ID NO: 51109 - DNA, 15 bp, Homo sapiens
gtgctcctgaaggtg

SEQ ID NO: 51110 - DNA, 15 bp, Homo sapiens
tgctcctgaaggtgt

SEQ ID NO: 51111 - DNA, 15 bp, Homo sapiens
gctcctgaaggtgtc

SEQ ID NO: 51112 - DNA, 15 bp, Homo sapiens
ctcctgaaggtgtca

SEQ ID NO: 51113 - DNA, 15 bp, Homo sapiens
tcctgaaggtgtcat

SEQ ID NO: 51114 - DNA, 15 bp, Homo sapiens
cctgaaggtgtcatt

SEQ ID NO: 51115 - DNA, 15 bp, Homo sapiens
ctgaaggtgtcattg

SEQ ID NO: 51116 - DNA, 15 bp, Homo sapiens
tgaaggtgtcattga

SEQ ID NO: 51117 - DNA, 15 bp, Homo sapiens
gaaggtgtcattgac

SEQ ID NO: 51118 - DNA, 15 bp, Homo sapiens
aaggtgtcattgaca

SEQ ID NO: 51119 - DNA, 15 bp, Homo sapiens
aggtgtcattgacag

SEQ ID NO: 51120 - DNA, 15 bp, Homo sapiens
ggtgtcattgacagg

SEQ ID NO: 51121 - DNA, 15 bp, Homo sapiens
gtgtcattgacaggt

SEQ ID NO: 51122 - DNA, 15 bp, Homo sapiens
tgtcattgacaggtg

SEQ ID NO: 51123 - DNA, 15 bp, Homo sapiens
gtcattgacaggtgc

SEQ ID NO: 51124 - DNA, 15 bp, Homo sapiens
tcattgacaggtgca

SEQ ID NO: 51125 - DNA, 15 bp, Homo sapiens
cattgacaggtgcac

SEQ ID NO: 51126 - DNA, 15 bp, Homo sapiens
attgacaggtgcacc

SEQ ID NO: 51127 - DNA, 15 bp, Homo sapiens
ttgacaggtgcaccc

SEQ ID NO: 51128 - DNA, 15 bp, Homo sapiens
tgacaggtgcaccca

SEQ ID NO: 51129 - DNA, 15 bp, Homo sapiens
gacaggtgcacccac

SEQ ID NO: 51130 - DNA, 15 bp, Homo sapiens
acaggtgcacccaca

SEQ ID NO: 51131 - DNA, 15 bp, Homo sapiens
caggtgcacccacat

SEQ ID NO: 51132 - DNA, 15 bp, Homo sapiens
aggtgcacccacatt

SEQ ID NO: 51133 - DNA, 15 bp, Homo sapiens
ggtgcacccacattc

SEQ ID NO: 51134 - DNA, 15 bp, Homo sapiens
gtgcacccacattcg

SEQ ID NO: 51135 - DNA, 15 bp, Homo sapiens
tgcacccacattcga

SEQ ID NO: 51136 - DNA, 15 bp, Homo sapiens
gcacccacattcgag

SEQ ID NO: 51137 - DNA, 15 bp, Homo sapiens
cacccacattcgagt

SEQ ID NO: 51138 - DNA, 15 bp, Homo sapiens
acccacattcgagtt

SEQ ID NO: 51139 - DNA, 15 bp, Homo sapiens
cccacattcgagttg

SEQ ID NO: 51140 - DNA, 15 bp, Homo sapiens
ccacattcgagttgg

SEQ ID NO: 51141 - DNA, 15 bp, Homo sapiens
cacattcgagttgga

SEQ ID NO: 51142 - DNA, 15 bp, Homo sapiens
acattcgagttggaa

SEQ ID NO: 51143 - DNA, 15 bp, Homo sapiens
cattcgagttggaag

SEQ ID NO: 51144 - DNA, 15 bp, Homo sapiens
attcgagttggaagt

SEQ ID NO: 51145 - DNA, 15 bp, Homo sapiens
ttcgagttggaagta

SEQ ID NO: 51146 - DNA, 15 bp, Homo sapiens
tcgagttggaagtac

SEQ ID NO: 51147 - DNA, 15 bp, Homo sapiens
cgagttggaagtact

SEQ ID NO: 51148 - DNA, 15 bp, Homo sapiens
gagttggaagtacta

SEQ ID NO: 51149 - DNA, 15 bp, Homo sapiens
agttggaagtactaa

SEQ ID NO: 51150 - DNA, 15 bp, Homo sapiens
gttggaagtactaag

SEQ ID NO: 51151 - DNA, 15 bp, Homo sapiens
ttggaagtactaagg

SEQ ID NO: 51152 - DNA, 15 bp, Homo sapiens
tggaagtactaaggt

SEQ ID NO: 51153 - DNA, 15 bp, Homo sapiens
ggaagtactaaggtt

SEQ ID NO: 51154 - DNA, 15 bp, Homo sapiens
gaagtactaaggttc

SEQ ID NO: 51155 - DNA, 15 bp, Homo sapiens
aagtactaaggttcc

SEQ ID NO: 51156 - DNA, 15 bp, Homo sapiens
agtactaaggttcct

SEQ ID NO: 51157 - DNA, 15 bp, Homo sapiens
gtactaaggttccta

SEQ ID NO: 51158 - DNA, 15 bp, Homo sapiens
tactaaggttcctat

SEQ ID NO: 51159 - DNA, 15 bp, Homo sapiens
actaaggttcctatg

SEQ ID NO: 51160 - DNA, 15 bp, Homo sapiens
ctaaggttcctatga

SEQ ID NO: 51161 - DNA, 15 bp, Homo sapiens
taaggttcctatgac

SEQ ID NO: 51162 - DNA, 15 bp, Homo sapiens
aaggttcctatgacc

SEQ ID NO: 51163 - DNA, 15 bp, Homo sapiens
aggttcctatgacct

SEQ ID NO: 51164 - DNA, 15 bp, Homo sapiens
ggttcctatgacctc

SEQ ID NO: 51165 - DNA, 15 bp, Homo sapiens
gttcctatgacctct

SEQ ID NO: 51166 - DNA, 15 bp, Homo sapiens
ttcctatgacctctg

SEQ ID NO: 51167 - DNA, 15 bp, Homo sapiens
tcctatgacctctgg

SEQ ID NO: 51168 - DNA, 15 bp, Homo sapiens
cctatgacctctgga

SEQ ID NO: 51169 - DNA, 15 bp, Homo sapiens
ctatgacctctggag

SEQ ID NO: 51170 - DNA, 15 bp, Homo sapiens
tatgacctctggagt

SEQ ID NO: 51171 - DNA, 15 bp, Homo sapiens
atgacctctggagtc

SEQ ID NO: 51172 - DNA, 15 bp, Homo sapiens
tgacctctggagtca

SEQ ID NO: 51173 - DNA, 15 bp, Homo sapiens
gacctctggagtcaa

SEQ ID NO: 51174 - DNA, 15 bp, Homo sapiens
acctctggagtcaaa

SEQ ID NO: 51175 - DNA, 15 bp, Homo sapiens
cctctggagtcaaac

SEQ ID NO: 51176 - DNA, 15 bp, Homo sapiens
ctctggagtcaaaca

SEQ ID NO: 51177 - DNA, 15 bp, Homo sapiens
tctggagtcaaacag

SEQ ID NO: 51178 - DNA, 15 bp, Homo sapiens
ctggagtcaaacaga

SEQ ID NO: 51179 - DNA, 15 bp, Homo sapiens
tggagtcaaacagaa

SEQ ID NO: 51180 - DNA, 15 bp, Homo sapiens
ggagtcaaacagaag

SEQ ID NO: 51181 - DNA, 15 bp, Homo sapiens
gagtcaaacagaaga

SEQ ID NO: 51182 - DNA, 15 bp, Homo sapiens
agtcaaacagaagat

SEQ ID NO: 51183 - DNA, 15 bp, Homo sapiens
gtcaaacagaagatc

SEQ ID NO: 51184 - DNA, 15 bp, Homo sapiens
tcaaacagaagatca

SEQ ID NO: 51185 - DNA, 15 bp, Homo sapiens
caaacagaagatcat

SEQ ID NO: 51186 - DNA, 15 bp, Homo sapiens
aaacagaagatcatg

SEQ ID NO: 51187 - DNA, 15 bp, Homo sapiens
aacagaagatcatgt

SEQ ID NO: 51188 - DNA, 15 bp, Homo sapiens
acagaagatcatgtc

SEQ ID NO: 51189 - DNA, 15 bp, Homo sapiens
cagaagatcatgtct

SEQ ID NO: 51190 - DNA, 15 bp, Homo sapiens
agaagatcatgtctg

SEQ ID NO: 51191 - DNA, 15 bp, Homo sapiens
gaagatcatgtctgt

SEQ ID NO: 51192 - DNA, 15 bp, Homo sapiens
aagatcatgtctgtc

SEQ ID NO: 51193 - DNA, 15 bp, Homo sapiens
agatcatgtctgtca

SEQ ID NO: 51194 - DNA, 15 bp, Homo sapiens
gatcatgtctgtcat

SEQ ID NO: 51195 - DNA, 15 bp, Homo sapiens
atcatgtctgtcatt

SEQ ID NO: 51196 - DNA, 15 bp, Homo sapiens
tcatgtctgtcattc

SEQ ID NO: 51197 - DNA, 15 bp, Homo sapiens
catgtctgtcattcg

SEQ ID NO: 51198 - DNA, 15 bp, Homo sapiens
atgtctgtcattcga

SEQ ID NO: 51199 - DNA, 15 bp, Homo sapiens
tgtctgtcattcgag

SEQ ID NO: 51200 - DNA, 15 bp, Homo sapiens
gtctgtcattcgaga

SEQ ID NO: 51201 - DNA, 15 bp, Homo sapiens
tctgtcattcgagag

SEQ ID NO: 51202 - DNA, 15 bp, Homo sapiens
ctgtcattcgagagt

SEQ ID NO: 51203 - DNA, 15 bp, Homo sapiens
tgtcattcgagagtg

SEQ ID NO: 51204 - DNA, 15 bp, Homo sapiens
gtcattcgagagtgg

SEQ ID NO: 51205 - DNA, 15 bp, Homo sapiens
tcattcgagagtggg

SEQ ID NO: 51206 - DNA, 15 bp, Homo sapiens
cattcgagagtgggg

SEQ ID NO: 51207 - DNA, 15 bp, Homo sapiens
attcgagagtggggt

SEQ ID NO: 51208 - DNA, 15 bp, Homo sapiens
ttcgagagtggggta

SEQ ID NO: 51209 - DNA, 15 bp, Homo sapiens
tcgagagtggggtag

SEQ ID NO: 51210 - DNA, 15 bp, Homo sapiens
cgagagtggggtagt

SEQ ID NO: 51211 - DNA, 15 bp, Homo sapiens
gagagtggggtagtg

SEQ ID NO: 51212 - DNA, 15 bp, Homo sapiens
agagtggggtagtgg

SEQ ID NO: 51213 - DNA, 15 bp, Homo sapiens
gagtggggtagtggc

SEQ ID NO: 51214 - DNA, 15 bp, Homo sapiens
agtggggtagtggca

SEQ ID NO: 51215 - DNA, 15 bp, Homo sapiens
gtggggtagtggcag

SEQ ID NO: 51216 - DNA, 15 bp, Homo sapiens
tggggtagtggcagc

SEQ ID NO: 51217 - DNA, 15 bp, Homo sapiens
ggggtagtggcagcg

SEQ ID NO: 51218 - DNA, 15 bp, Homo sapiens
gggtagtggcagcga

SEQ ID NO: 51219 - DNA, 15 bp, Homo sapiens
ggtagtggcagcgac

SEQ ID NO: 51220 - DNA, 15 bp, Homo sapiens
gtagtggcagcgaca

SEQ ID NO: 51221 - DNA, 15 bp, Homo sapiens
tagtggcagcgacac

SEQ ID NO: 51222 - DNA, 15 bp, Homo sapiens
agtggcagcgacaca

SEQ ID NO: 51223 - DNA, 15 bp, Homo sapiens
gtggcagcgacacac

SEQ ID NO: 51224 - DNA, 15 bp, Homo sapiens
tggcagcgacacact

SEQ ID NO: 51225 - DNA, 15 bp, Homo sapiens
ggcagcgacacactg

SEQ ID NO: 51226 - DNA, 15 bp, Homo sapiens
gcagcgacacactgc

SEQ ID NO: 51227 - DNA, 15 bp, Homo sapiens
cagcgacacactgcg

SEQ ID NO: 51228 - DNA, 15 bp, Homo sapiens
agcgacacactgcga

SEQ ID NO: 51229 - DNA, 15 bp, Homo sapiens
gcgacacactgcgat

SEQ ID NO: 51230 - DNA, 15 bp, Homo sapiens
cgacacactgcgatg

SEQ ID NO: 51231 - DNA, 15 bp, Homo sapiens
gacacactgcgatgc

SEQ ID NO: 51232 - DNA, 15 bp, Homo sapiens
acacactgcgatgcc

SEQ ID NO: 51233 - DNA, 15 bp, Homo sapiens
cacactgcgatgcct

SEQ ID NO: 51234 - DNA, 15 bp, Homo sapiens
acactgcgatgcctg

SEQ ID NO: 51235 - DNA, 15 bp, Homo sapiens
cactgcgatgcctgg

SEQ ID NO: 51236 - DNA, 15 bp, Homo sapiens
actgcgatgcctggc

SEQ ID NO: 51237 - DNA, 15 bp, Homo sapiens
ctgcgatgcctggcc

SEQ ID NO: 51238 - DNA, 15 bp, Homo sapiens
tgcgatgcctggccc

SEQ ID NO: 51239 - DNA, 15 bp, Homo sapiens
gcgatgcctggccct

SEQ ID NO: 51240 - DNA, 15 bp, Homo sapiens
cgatgcctggccctg

SEQ ID NO: 51241 - DNA, 15 bp, Homo sapiens
gatgcctggccctgg

SEQ ID NO: 51242 - DNA, 15 bp, Homo sapiens
atgcctggccctggc

SEQ ID NO: 51243 - DNA, 15 bp, Homo sapiens
tgcctggccctggcc

SEQ ID NO: 51244 - DNA, 15 bp, Homo sapiens
gcctggccctggcca

SEQ ID NO: 51245 - DNA, 15 bp, Homo sapiens
cctggccctggccac

SEQ ID NO: 51246 - DNA, 15 bp, Homo sapiens
ctggccctggccact

SEQ ID NO: 51247 - DNA, 15 bp, Homo sapiens
tggccctggccactc

SEQ ID NO: 51248 - DNA, 15 bp, Homo sapiens
ggccctggccactca

SEQ ID NO: 51249 - DNA, 15 bp, Homo sapiens
gccctggccactcat

SEQ ID NO: 51250 - DNA, 15 bp, Homo sapiens
ccctggccactcatg

SEQ ID NO: 51251 - DNA, 15 bp, Homo sapiens
cctggccactcatga

SEQ ID NO: 51252 - DNA, 15 bp, Homo sapiens
ctggccactcatgac

SEQ ID NO: 51253 - DNA, 15 bp, Homo sapiens
tggccactcatgaca

SEQ ID NO: 51254 - DNA, 15 bp, Homo sapiens
ggccactcatgacaa

SEQ ID NO: 51255 - DNA, 15 bp, Homo sapiens
gccactcatgacaac

SEQ ID NO: 51256 - DNA, 15 bp, Homo sapiens
ccactcatgacaacc

SEQ ID NO: 51257 - DNA, 15 bp, Homo sapiens
cactcatgacaaccc

SEQ ID NO: 51258 - DNA, 15 bp, Homo sapiens
actcatgacaaccca

SEQ ID NO: 51259 - DNA, 15 bp, Homo sapiens
ctcatgacaacccac

SEQ ID NO: 51260 - DNA, 15 bp, Homo sapiens
tcatgacaacccact

SEQ ID NO: 51261 - DNA, 15 bp, Homo sapiens
catgacaacccactg

SEQ ID NO: 51262 - DNA, 15 bp, Homo sapiens
atgacaacccactga

SEQ ID NO: 51263 - DNA, 15 bp, Homo sapiens
tgacaacccactgag

SEQ ID NO: 51264 - DNA, 15 bp, Homo sapiens
gacaacccactgaga

SEQ ID NO: 51265 - DNA, 15 bp, Homo sapiens
acaacccactgagaa

SEQ ID NO: 51266 - DNA, 15 bp, Homo sapiens
caacccactgagaag

SEQ ID NO: 51267 - DNA, 15 bp, Homo sapiens
aacccactgagaaga

SEQ ID NO: 51268 - DNA, 15 bp, Homo sapiens
acccactgagaagag

SEQ ID NO: 51269 - DNA, 15 bp, Homo sapiens
cccactgagaagaga

SEQ ID NO: 51270 - DNA, 15 bp, Homo sapiens
ccactgagaagagaa

SEQ ID NO: 51271 - DNA, 15 bp, Homo sapiens
cactgagaagagaag

SEQ ID NO: 51272 - DNA, 15 bp, Homo sapiens
actgagaagagaaga

SEQ ID NO: 51273 - DNA, 15 bp, Homo sapiens
ctgagaagagaagaa

SEQ ID NO: 51274 - DNA, 15 bp, Homo sapiens
tgagaagagaagaaa

SEQ ID NO: 51275 - DNA, 15 bp, Homo sapiens
gagaagagaagaaat

SEQ ID NO: 51276 - DNA, 15 bp, Homo sapiens
agaagagaagaaatg

SEQ ID NO: 51277 - DNA, 15 bp, Homo sapiens
gaagagaagaaatgc

SEQ ID NO: 51278 - DNA, 15 bp, Homo sapiens
aagagaagaaatgca

SEQ ID NO: 51279 - DNA, 15 bp, Homo sapiens
agagaagaaatgcac

SEQ ID NO: 51280 - DNA, 15 bp, Homo sapiens
gagaagaaatgcacc

SEQ ID NO: 51281 - DNA, 15 bp, Homo sapiens
agaagaaatgcacct

SEQ ID NO: 51282 - DNA, 15 bp, Homo sapiens
gaagaaatgcacctt

SEQ ID NO: 51283 - DNA, 15 bp, Homo sapiens
aagaaatgcaccttg

SEQ ID NO: 51284 - DNA, 15 bp, Homo sapiens
agaaatgcaccttga

SEQ ID NO: 51285 - DNA, 15 bp, Homo sapiens
gaaatgcaccttgag

SEQ ID NO: 51286 - DNA, 15 bp, Homo sapiens
aaatgcaccttgagg

SEQ ID NO: 51287 - DNA, 15 bp, Homo sapiens
aatgcaccttgagga

SEQ ID NO: 51288 - DNA, 15 bp, Homo sapiens
atgcaccttgaggac

SEQ ID NO: 51289 - DNA, 15 bp, Homo sapiens
tgcaccttgaggact

SEQ ID NO: 51290 - DNA, 15 bp, Homo sapiens
gcaccttgaggactc

SEQ ID NO: 51291 - DNA, 15 bp, Homo sapiens
caccttgaggactct

SEQ ID NO: 51292 - DNA, 15 bp, Homo sapiens
accttgaggactctg

SEQ ID NO: 51293 - DNA, 15 bp, Homo sapiens
ccttgaggactctgc

SEQ ID NO: 51294 - DNA, 15 bp, Homo sapiens
cttgaggactctgcc

SEQ ID NO: 51295 - DNA, 15 bp, Homo sapiens
ttgaggactctgcca

SEQ ID NO: 51296 - DNA, 15 bp, Homo sapiens
tgaggactctgccaa

SEQ ID NO: 51297 - DNA, 15 bp, Homo sapiens
gaggactctgccaac

SEQ ID NO: 51298 - DNA, 15 bp, Homo sapiens
aggactctgccaact

SEQ ID NO: 51299 - DNA, 15 bp, Homo sapiens
ggactctgccaactt

SEQ ID NO: 51300 - DNA, 15 bp, Homo sapiens
gactctgccaacttt

SEQ ID NO: 51301 - DNA, 15 bp, Homo sapiens
actctgccaacttta

SEQ ID NO: 51302 - DNA, 15 bp, Homo sapiens
ctctgccaactttat

SEQ ID NO: 51303 - DNA, 15 bp, Homo sapiens
tctgccaactttatt

SEQ ID NO: 51304 - DNA, 15 bp, Homo sapiens
ctgccaactttatta

SEQ ID NO: 51305 - DNA, 15 bp, Homo sapiens
tgccaactttattaa

SEQ ID NO: 51306 - DNA, 15 bp, Homo sapiens
gccaactttattaaa

SEQ ID NO: 51307 - DNA, 15 bp, Homo sapiens
ccaactttattaaat

SEQ ID NO: 51308 - DNA, 15 bp, Homo sapiens
caactttattaaata

SEQ ID NO: 51309 - DNA, 15 bp, Homo sapiens
aactttattaaatat

SEQ ID NO: 51310 - DNA, 15 bp, Homo sapiens
actttattaaatatg

SEQ ID NO: 51311 - DNA, 15 bp, Homo sapiens
ctttattaaatatga

SEQ ID NO: 51312 - DNA, 15 bp, Homo sapiens
tttattaaatatgag

SEQ ID NO: 51313 - DNA, 15 bp, Homo sapiens
ttattaaatatgagg

SEQ ID NO: 51314 - DNA, 15 bp, Homo sapiens
tattaaatatgaggt

SEQ ID NO: 51315 - DNA, 15 bp, Homo sapiens
attaaatatgaggtt

SEQ ID NO: 51316 - DNA, 15 bp, Homo sapiens
ttaaatatgaggtta

SEQ ID NO: 51317 - DNA, 15 bp, Homo sapiens
taaatatgaggttag

SEQ ID NO: 51318 - DNA, 15 bp, Homo sapiens
aaatatgaggttagc

SEQ ID NO: 51319 - DNA, 15 bp, Homo sapiens
aatatgaggttagct

SEQ ID NO: 51320 - DNA, 15 bp, Homo sapiens
atatgaggttagcta

SEQ ID NO: 51321 - DNA, 15 bp, Homo sapiens
tatgaggttagctaa

SEQ ID NO: 51322 - DNA, 15 bp, Homo sapiens
atgaggttagctaat

SEQ ID NO: 51323 - DNA, 15 bp, Homo sapiens
tgaggttagctaatg

SEQ ID NO: 51324 - DNA, 15 bp, Homo sapiens
gaggttagctaatga

SEQ ID NO: 51325 - DNA, 15 bp, Homo sapiens
aggttagctaatgaa

SEQ ID NO: 51326 - DNA, 15 bp, Homo sapiens
ggttagctaatgaaa

SEQ ID NO: 51327 - DNA, 15 bp, Homo sapiens
gttagctaatgaaaa

SEQ ID NO: 51328 - DNA, 15 bp, Homo sapiens
ttagctaatgaaaag

SEQ ID NO: 51329 - DNA, 15 bp, Homo sapiens
tagctaatgaaaagt

SEQ ID NO: 51330 - DNA, 15 bp, Homo sapiens
agctaatgaaaagtt

SEQ ID NO: 51331 - DNA, 15 bp, Homo sapiens
gctaatgaaaagttt

SEQ ID NO: 51332 - DNA, 15 bp, Homo sapiens
ctaatgaaaagtttc

SEQ ID NO: 51333 - DNA, 15 bp, Homo sapiens
taatgaaaagtttct

SEQ ID NO: 51334 - DNA, 15 bp, Homo sapiens
aatgaaaagtttctt

SEQ ID NO: 51335 - DNA, 15 bp, Homo sapiens
atgaaaagtttcttt

SEQ ID NO: 51336 - DNA, 15 bp, Homo sapiens
tgaaaagtttctttg

SEQ ID NO: 51337 - DNA, 15 bp, Homo sapiens
gaaaagtttctttgt

SEQ ID NO: 51338 - DNA, 15 bp, Homo sapiens
aaaagtttctttgtc

SEQ ID NO: 51339 - DNA, 15 bp, Homo sapiens
aaagtttctttgtcc

SEQ ID NO: 51340 - DNA, 15 bp, Homo sapiens
aagtttctttgtcca

SEQ ID NO: 51341 - DNA, 15 bp, Homo sapiens
agtttctttgtccac

SEQ ID NO: 51342 - DNA, 15 bp, Homo sapiens
gtttctttgtccaca

SEQ ID NO: 51343 - DNA, 15 bp, Homo sapiens
tttctttgtccacac

SEQ ID NO: 51344 - DNA, 15 bp, Homo sapiens
ttctttgtccacacc

SEQ ID NO: 51345 - DNA, 15 bp, Homo sapiens
tctttgtccacaccc

SEQ ID NO: 51346 - DNA, 15 bp, Homo sapiens
ctttgtccacaccct

SEQ ID NO: 51347 - DNA, 15 bp, Homo sapiens
tttgtccacaccctg

SEQ ID NO: 51348 - DNA, 15 bp, Homo sapiens
ttgtccacaccctgc

SEQ ID NO: 51349 - DNA, 15 bp, Homo sapiens
tgtccacaccctgca

SEQ ID NO: 51350 - DNA, 15 bp, Homo sapiens
gtccacaccctgcac

SEQ ID NO: 51351 - DNA, 15 bp, Homo sapiens
tccacaccctgcacg

SEQ ID NO: 51352 - DNA, 15 bp, Homo sapiens
ccacaccctgcacga

SEQ ID NO: 51353 - DNA, 15 bp, Homo sapiens
cacaccctgcacgat

SEQ ID NO: 51354 - DNA, 15 bp, Homo sapiens
acaccctgcacgatt

SEQ ID NO: 51355 - DNA, 15 bp, Homo sapiens
caccctgcacgattc

SEQ ID NO: 51356 - DNA, 15 bp, Homo sapiens
accctgcacgattca

SEQ ID NO: 51357 - DNA, 15 bp, Homo sapiens
ccctgcacgattcat

SEQ ID NO: 51358 - DNA, 15 bp, Homo sapiens
cctgcacgattcatt

SEQ ID NO: 51359 - DNA, 15 bp, Homo sapiens
ctgcacgattcattg

SEQ ID NO: 51360 - DNA, 15 bp, Homo sapiens
tgcacgattcattgt

SEQ ID NO: 51361 - DNA, 15 bp, Homo sapiens
gcacgattcattgtg

SEQ ID NO: 51362 - DNA, 15 bp, Homo sapiens
cacgattcattgtgt

SEQ ID NO: 51363 - DNA, 15 bp, Homo sapiens
acgattcattgtgtt

SEQ ID NO: 51364 - DNA, 15 bp, Homo sapiens
cgattcattgtgttt

SEQ ID NO: 51365 - DNA, 15 bp, Homo sapiens
gattcattgtgttta

SEQ ID NO: 51366 - DNA, 15 bp, Homo sapiens
attcattgtgtttaa

SEQ ID NO: 51367 - DNA, 15 bp, Homo sapiens
ttcattgtgtttaaa

SEQ ID NO: 51368 - DNA, 15 bp, Homo sapiens
tcattgtgtttaaac

SEQ ID NO: 51369 - DNA, 15 bp, Homo sapiens
cattgtgtttaaaca

SEQ ID NO: 51370 - DNA, 15 bp, Homo sapiens
attgtgtttaaacag

SEQ ID NO: 51371 - DNA, 15 bp, Homo sapiens
ttgtgtttaaacagt

SEQ ID NO: 51372 - DNA, 15 bp, Homo sapiens
tgtgtttaaacagta

SEQ ID NO: 51373 - DNA, 15 bp, Homo sapiens
gtgtttaaacagtac

SEQ ID NO: 51374 - DNA, 15 bp, Homo sapiens
tgtttaaacagtact

SEQ ID NO: 51375 - DNA, 15 bp, Homo sapiens
gtttaaacagtactc

SEQ ID NO: 51376 - DNA, 15 bp, Homo sapiens
tttaaacagtactcc

SEQ ID NO: 51377 - DNA, 15 bp, Homo sapiens
ttaaacagtactcct

SEQ ID NO: 51378 - DNA, 15 bp, Homo sapiens
taaacagtactcctt

SEQ ID NO: 51379 - DNA, 15 bp, Homo sapiens
aaacagtactccttc

SEQ ID NO: 51380 - DNA, 15 bp, Homo sapiens
aacagtactccttca

SEQ ID NO: 51381 - DNA, 15 bp, Homo sapiens
acagtactccttcaa

SEQ ID NO: 51382 - DNA, 15 bp, Homo sapiens
cagtactccttcaag

SEQ ID NO: 51383 - DNA, 15 bp, Homo sapiens
agtactccttcaagc

SEQ ID NO: 51384 - DNA, 15 bp, Homo sapiens
gtactccttcaagca

SEQ ID NO: 51385 - DNA, 15 bp, Homo sapiens
tactccttcaagcaa

SEQ ID NO: 51386 - DNA, 15 bp, Homo sapiens
actccttcaagcaaa

SEQ ID NO: 51387 - DNA, 15 bp, Homo sapiens
ctccttcaagcaaaa

SEQ ID NO: 51388 - DNA, 15 bp, Homo sapiens
tccttcaagcaaaag

SEQ ID NO: 51389 - DNA, 15 bp, Homo sapiens
ccttcaagcaaaagg

SEQ ID NO: 51390 - DNA, 15 bp, Homo sapiens
cttcaagcaaaaggt

SEQ ID NO: 51391 - DNA, 15 bp, Homo sapiens
ttcaagcaaaaggtc

SEQ ID NO: 51392 - DNA, 15 bp, Homo sapiens
tcaagcaaaaggtca

SEQ ID NO: 51393 - DNA, 15 bp, Homo sapiens
caagcaaaaggtcaa

SEQ ID NO: 51394 - DNA, 15 bp, Homo sapiens
aagcaaaaggtcaaa

SEQ ID NO: 51395 - DNA, 15 bp, Homo sapiens
agcaaaaggtcaaac

SEQ ID NO: 51396 - DNA, 15 bp, Homo sapiens
gcaaaaggtcaaaca

SEQ ID NO: 51397 - DNA, 15 bp, Homo sapiens
caaaaggtcaaacag

SEQ ID NO: 51398 - DNA, 15 bp, Homo sapiens
aaaaggtcaaacagt

SEQ ID NO: 51399 - DNA, 15 bp, Homo sapiens
aaaggtcaaacagtt

SEQ ID NO: 51400 - DNA, 15 bp, Homo sapiens
aaggtcaaacagttc

SEQ ID NO: 51401 - DNA, 15 bp, Homo sapiens
aggtcaaacagttct

SEQ ID NO: 51402 - DNA, 15 bp, Homo sapiens
ggtcaaacagttctc

SEQ ID NO: 51403 - DNA, 15 bp, Homo sapiens
gtcaaacagttctca

SEQ ID NO: 51404 - DNA, 15 bp, Homo sapiens
tcaaacagttctcac

SEQ ID NO: 51405 - DNA, 15 bp, Homo sapiens
caaacagttctcact

SEQ ID NO: 51406 - DNA, 15 bp, Homo sapiens
aaacagttctcactt

SEQ ID NO: 51407 - DNA, 15 bp, Homo sapiens
aacagttctcacttt

SEQ ID NO: 51408 - DNA, 15 bp, Homo sapiens
acagttctcactttt

SEQ ID NO: 51409 - DNA, 15 bp, Homo sapiens
cagttctcacttttg

SEQ ID NO: 51410 - DNA, 15 bp, Homo sapiens
agttctcacttttgc

SEQ ID NO: 51411 - DNA, 15 bp, Homo sapiens
gttctcacttttgcc

SEQ ID NO: 51412 - DNA, 15 bp, Homo sapiens
ttctcacttttgcca

SEQ ID NO: 51413 - DNA, 15 bp, Homo sapiens
tctcacttttgccaa

SEQ ID NO: 51414 - DNA, 15 bp, Homo sapiens
ctcacttttgccaag

SEQ ID NO: 51415 - DNA, 15 bp, Homo sapiens
tcacttttgccaaga

SEQ ID NO: 51416 - DNA, 15 bp, Homo sapiens
cacttttgccaagaa

SEQ ID NO: 51417 - DNA, 15 bp, Homo sapiens
acttttgccaagaaa

SEQ ID NO: 51418 - DNA, 15 bp, Homo sapiens
cttttgccaagaaag

SEQ ID NO: 51419 - DNA, 15 bp, Homo sapiens
ttttgccaagaaaga

SEQ ID NO: 51420 - DNA, 15 bp, Homo sapiens
tttgccaagaaagag

SEQ ID NO: 51421 - DNA, 15 bp, Homo sapiens
ttgccaagaaagagg

SEQ ID NO: 51422 - DNA, 15 bp, Homo sapiens
tgccaagaaagaggt

SEQ ID NO: 51423 - DNA, 15 bp, Homo sapiens
gccaagaaagaggtg

SEQ ID NO: 51424 - DNA, 15 bp, Homo sapiens
ccaagaaagaggtgt

SEQ ID NO: 51425 - DNA, 15 bp, Homo sapiens
caagaaagaggtgtg

SEQ ID NO: 51426 - DNA, 15 bp, Homo sapiens
aagaaagaggtgtgg

SEQ ID NO: 51427 - DNA, 15 bp, Homo sapiens
agaaagaggtgtggt

SEQ ID NO: 51428 - DNA, 15 bp, Homo sapiens
gaaagaggtgtggtt

SEQ ID NO: 51429 - DNA, 15 bp, Homo sapiens
aaagaggtgtggtta

SEQ ID NO: 51430 - DNA, 15 bp, Homo sapiens
aagaggtgtggttat

SEQ ID NO: 51431 - DNA, 15 bp, Homo sapiens
agaggtgtggttatt

SEQ ID NO: 51432 - DNA, 15 bp, Homo sapiens
gaggtgtggttattt

SEQ ID NO: 51433 - DNA, 15 bp, Homo sapiens
aggtgtggttatttg

SEQ ID NO: 51434 - DNA, 15 bp, Homo sapiens
ggtgtggttatttgt

SEQ ID NO: 51435 - DNA, 15 bp, Homo sapiens
gtgtggttatttgtt

SEQ ID NO: 51436 - DNA, 15 bp, Homo sapiens
tgtggttatttgttt

SEQ ID NO: 51437 - DNA, 15 bp, Homo sapiens
gtggttatttgtttt

SEQ ID NO: 51438 - DNA, 15 bp, Homo sapiens
tggttatttgttttt

SEQ ID NO: 51439 - DNA, 15 bp, Homo sapiens
ggttatttgtttttc

SEQ ID NO: 51440 - DNA, 15 bp, Homo sapiens
gttatttgtttttct

SEQ ID NO: 51441 - DNA, 15 bp, Homo sapiens
ttatttgtttttctg

SEQ ID NO: 51442 - DNA, 15 bp, Homo sapiens
tatttgtttttctgc

SEQ ID NO: 51443 - DNA, 15 bp, Homo sapiens
atttgtttttctgcc

SEQ ID NO: 51444 - DNA, 15 bp, Homo sapiens
tttgtttttctgcct

SEQ ID NO: 51445 - DNA, 15 bp, Homo sapiens
ttgtttttctgcctg

SEQ ID NO: 51446 - DNA, 15 bp, Homo sapiens
tgtttttctgcctgc

SEQ ID NO: 51447 - DNA, 15 bp, Homo sapiens
gtttttctgcctgcc

SEQ ID NO: 51448 - DNA, 15 bp, Homo sapiens
tttttctgcctgcca

SEQ ID NO: 51449 - DNA, 15 bp, Homo sapiens
ttttctgcctgccag

SEQ ID NO: 51450 - DNA, 15 bp, Homo sapiens
tttctgcctgccagc

SEQ ID NO: 51451 - DNA, 15 bp, Homo sapiens
ttctgcctgccagct

SEQ ID NO: 51452 - DNA, 15 bp, Homo sapiens
tctgcctgccagctg

SEQ ID NO: 51453 - DNA, 15 bp, Homo sapiens
ctgcctgccagctgt

SEQ ID NO: 51454 - DNA, 15 bp, Homo sapiens
tgcctgccagctgtg

SEQ ID NO: 51455 - DNA, 15 bp, Homo sapiens
gcctgccagctgtgt

SEQ ID NO: 51456 - DNA, 15 bp, Homo sapiens
cctgccagctgtgtc

SEQ ID NO: 51457 - DNA, 15 bp, Homo sapiens
ctgccagctgtgtca

SEQ ID NO: 51458 - DNA, 15 bp, Homo sapiens
tgccagctgtgtcac

SEQ ID NO: 51459 - DNA, 15 bp, Homo sapiens
gccagctgtgtcacc

SEQ ID NO: 51460 - DNA, 15 bp, Homo sapiens
ccagctgtgtcaccc

SEQ ID NO: 51461 - DNA, 15 bp, Homo sapiens
cagctgtgtcaccct

SEQ ID NO: 51462 - DNA, 15 bp, Homo sapiens
agctgtgtcaccctt

SEQ ID NO: 51463 - DNA, 15 bp, Homo sapiens
gctgtgtcaccctta

SEQ ID NO: 51464 - DNA, 15 bp, Homo sapiens
ctgtgtcacccttaa

SEQ ID NO: 51465 - DNA, 15 bp, Homo sapiens
tgtgtcacccttaaa

SEQ ID NO: 51466 - DNA, 15 bp, Homo sapiens
gtgtcacccttaaaa

SEQ ID NO: 51467 - DNA, 15 bp, Homo sapiens
tgtcacccttaaaat

SEQ ID NO: 51468 - DNA, 15 bp, Homo sapiens
gtcacccttaaaatt

SEQ ID NO: 51469 - DNA, 15 bp, Homo sapiens
tcacccttaaaattt

SEQ ID NO: 51470 - DNA, 15 bp, Homo sapiens
cacccttaaaatttg

SEQ ID NO: 51471 - DNA, 15 bp, Homo sapiens
acccttaaaatttgc

SEQ ID NO: 51472 - DNA, 15 bp, Homo sapiens
cccttaaaatttgct

SEQ ID NO: 51473 - DNA, 15 bp, Homo sapiens
ccttaaaatttgctg

SEQ ID NO: 51474 - DNA, 15 bp, Homo sapiens
cttaaaatttgctgc

SEQ ID NO: 51475 - DNA, 15 bp, Homo sapiens
ttaaaatttgctgct

SEQ ID NO: 51476 - DNA, 15 bp, Homo sapiens
taaaatttgctgctt

SEQ ID NO: 51477 - DNA, 15 bp, Homo sapiens
aaaatttgctgcttc

SEQ ID NO: 51478 - DNA, 15 bp, Homo sapiens
aaatttgctgcttca

SEQ ID NO: 51479 - DNA, 15 bp, Homo sapiens
aatttgctgcttcaa

SEQ ID NO: 51480 - DNA, 15 bp, Homo sapiens
atttgctgcttcaaa

SEQ ID NO: 51481 - DNA, 15 bp, Homo sapiens
tttgctgcttcaaac

SEQ ID NO: 51482 - DNA, 15 bp, Homo sapiens
ttgctgcttcaaaca

SEQ ID NO: 51483 - DNA, 15 bp, Homo sapiens
tgctgcttcaaacat

SEQ ID NO: 51484 - DNA, 15 bp, Homo sapiens
gctgcttcaaacata

SEQ ID NO: 51485 - DNA, 15 bp, Homo sapiens
ctgcttcaaacatac

SEQ ID NO: 51486 - DNA, 15 bp, Homo sapiens
tgcttcaaacataca

SEQ ID NO: 51487 - DNA, 15 bp, Homo sapiens
gcttcaaacatacat

SEQ ID NO: 51488 - DNA, 15 bp, Homo sapiens
cttcaaacatacata

SEQ ID NO: 51489 - DNA, 15 bp, Homo sapiens
ttcaaacatacatag

SEQ ID NO: 51490 - DNA, 15 bp, Homo sapiens
tcaaacatacatagt

SEQ ID NO: 51491 - DNA, 15 bp, Homo sapiens
caaacatacatagtt

SEQ ID NO: 51492 - DNA, 15 bp, Homo sapiens
aaacatacatagtta

SEQ ID NO: 51493 - DNA, 15 bp, Homo sapiens
aacatacatagttaa

SEQ ID NO: 51494 - DNA, 15 bp, Homo sapiens
acatacatagttaat

SEQ ID NO: 51495 - DNA, 15 bp, Homo sapiens
catacatagttaata

SEQ ID NO: 51496 - DNA, 15 bp, Homo sapiens
atacatagttaataa

SEQ ID NO: 51497 - DNA, 15 bp, Homo sapiens
tacatagttaataat

SEQ ID NO: 51498 - DNA, 15 bp, Homo sapiens
acatagttaataatt

SEQ ID NO: 51499 - DNA, 15 bp, Homo sapiens
catagttaataattt

SEQ ID NO: 51500 - DNA, 15 bp, Homo sapiens
atagttaataatttc

SEQ ID NO: 51501 - DNA, 15 bp, Homo sapiens
tagttaataatttca

SEQ ID NO: 51502 - DNA, 15 bp, Homo sapiens
agttaataatttcat

SEQ ID NO: 51503 - DNA, 15 bp, Homo sapiens
gttaataatttcata

SEQ ID NO: 51504 - DNA, 15 bp, Homo sapiens
ttaataatttcataa

SEQ ID NO: 51505 - DNA, 15 bp, Homo sapiens
taataatttcataaa

SEQ ID NO: 51506 - DNA, 15 bp, Homo sapiens
aataatttcataaaa

SEQ ID NO: 51507 - DNA, 15 bp, Homo sapiens
ataatttcataaaag

SEQ ID NO: 51508 - DNA, 15 bp, Homo sapiens
taatttcataaaagt

SEQ ID NO: 51509 - DNA, 15 bp, Homo sapiens
aatttcataaaagtg

SEQ ID NO: 51510 - DNA, 15 bp, Homo sapiens
atttcataaaagtgt

SEQ ID NO: 51511 - DNA, 15 bp, Homo sapiens
tttcataaaagtgtt

SEQ ID NO: 51512 - DNA, 15 bp, Homo sapiens
ttcataaaagtgtta

SEQ ID NO: 51513 - DNA, 15 bp, Homo sapiens
tcataaaagtgttat

SEQ ID NO: 51514 - DNA, 15 bp, Homo sapiens
cataaaagtgttatt

SEQ ID NO: 51515 - DNA, 15 bp, Homo sapiens
ataaaagtgttattt

SEQ ID NO: 51516 - DNA, 15 bp, Homo sapiens
taaaagtgttatttt

SEQ ID NO: 51517 - DNA, 15 bp, Homo sapiens
aaaagtgttattttc

SEQ ID NO: 51518 - DNA, 15 bp, Homo sapiens
aaagtgttattttca

SEQ ID NO: 51519 - DNA, 15 bp, Homo sapiens
aagtgttattttcaa

SEQ ID NO: 51520 - DNA, 15 bp, Homo sapiens
agtgttattttcaaa

SEQ ID NO: 51521 - DNA, 15 bp, Homo sapiens
gtgttattttcaaag

SEQ ID NO: 51522 - DNA, 15 bp, Homo sapiens
tgttattttcaaagt

SEQ ID NO: 51523 - DNA, 15 bp, Homo sapiens
gttattttcaaagta

SEQ ID NO: 51524 - DNA, 15 bp, Homo sapiens
ttattttcaaagtag

SEQ ID NO: 51525 - DNA, 15 bp, Homo sapiens
tattttcaaagtaga

SEQ ID NO: 51526 - DNA, 15 bp, Homo sapiens
attttcaaagtagaa

SEQ ID NO: 51527 - DNA, 15 bp, Homo sapiens
ttttcaaagtagaat

SEQ ID NO: 51528 - DNA, 15 bp, Homo sapiens
tttcaaagtagaata

SEQ ID NO: 51529 - DNA, 15 bp, Homo sapiens
ttcaaagtagaatat

SEQ ID NO: 51530 - DNA, 15 bp, Homo sapiens
tcaaagtagaatatt

SEQ ID NO: 51531 - DNA, 15 bp, Homo sapiens
caaagtagaatattt

SEQ ID NO: 51532 - DNA, 15 bp, Homo sapiens
aaagtagaatatttt

SEQ ID NO: 51533 - DNA, 15 bp, Homo sapiens
aagtagaatattttc

SEQ ID NO: 51534 - DNA, 15 bp, Homo sapiens
agtagaatattttca

SEQ ID NO: 51535 - DNA, 15 bp, Homo sapiens
gtagaatattttcaa

SEQ ID NO: 51536 - DNA, 15 bp, Homo sapiens
tagaatattttcaaa

SEQ ID NO: 51537 - DNA, 15 bp, Homo sapiens
agaatattttcaaag

SEQ ID NO: 51538 - DNA, 15 bp, Homo sapiens
gaatattttcaaagt

SEQ ID NO: 51539 - DNA, 15 bp, Homo sapiens
aatattttcaaagta

SEQ ID NO: 51540 - DNA, 15 bp, Homo sapiens
atattttcaaagtag

SEQ ID NO: 51541 - DNA, 15 bp, Homo sapiens
ttcaaagtagaataa

SEQ ID NO: 51542 - DNA, 15 bp, Homo sapiens
tcaaagtagaataat

SEQ ID NO: 51543 - DNA, 15 bp, Homo sapiens
caaagtagaataatc

SEQ ID NO: 51544 - DNA, 15 bp, Homo sapiens
aaagtagaataatca

SEQ ID NO: 51545 - DNA, 15 bp, Homo sapiens
aagtagaataatcaa

SEQ ID NO: 51546 - DNA, 15 bp, Homo sapiens
agtagaataatcaag

SEQ ID NO: 51547 - DNA, 15 bp, Homo sapiens
gtagaataatcaaga

SEQ ID NO: 51548 - DNA, 15 bp, Homo sapiens
tagaataatcaagat

SEQ ID NO: 51549 - DNA, 15 bp, Homo sapiens
agaataatcaagatg

SEQ ID NO: 51550 - DNA, 15 bp, Homo sapiens
gaataatcaagatga

SEQ ID NO: 51551 - DNA, 15 bp, Homo sapiens
aataatcaagatgag

SEQ ID NO: 51552 - DNA, 15 bp, Homo sapiens
ataatcaagatgagc

SEQ ID NO: 51553 - DNA, 15 bp, Homo sapiens
taatcaagatgagct

SEQ ID NO: 51554 - DNA, 15 bp, Homo sapiens
aatcaagatgagctt

SEQ ID NO: 51555 - DNA, 15 bp, Homo sapiens
atcaagatgagctta

SEQ ID NO: 51556 - DNA, 15 bp, Homo sapiens
tcaagatgagcttaa

SEQ ID NO: 51557 - DNA, 15 bp, Homo sapiens
caagatgagcttaag

SEQ ID NO: 51558 - DNA, 15 bp, Homo sapiens
aagatgagcttaagc

SEQ ID NO: 51559 - DNA, 15 bp, Homo sapiens
agatgagcttaagct

SEQ ID NO: 51560 - DNA, 15 bp, Homo sapiens
gatgagcttaagctt

SEQ ID NO: 51561 - DNA, 15 bp, Homo sapiens
atgagcttaagcttg

SEQ ID NO: 51562 - DNA, 15 bp, Homo sapiens
tgagcttaagcttgt

SEQ ID NO: 51563 - DNA, 15 bp, Homo sapiens
gagcttaagcttgta

SEQ ID NO: 51564 - DNA, 15 bp, Homo sapiens
agcttaagcttgtaa

SEQ ID NO: 51565 - DNA, 15 bp, Homo sapiens
gcttaagcttgtaaa

SEQ ID NO: 51566 - DNA, 15 bp, Homo sapiens
cttaagcttgtaaac

SEQ ID NO: 51567 - DNA, 15 bp, Homo sapiens
ttaagcttgtaaacc

SEQ ID NO: 51568 - DNA, 15 bp, Homo sapiens
taagcttgtaaaccc

SEQ ID NO: 51569 - DNA, 15 bp, Homo sapiens
aagcttgtaaacccc

SEQ ID NO: 51570 - DNA, 15 bp, Homo sapiens
agcttgtaaacccca

SEQ ID NO: 51571 - DNA, 15 bp, Homo sapiens
gcttgtaaaccccat

SEQ ID NO: 51572 - DNA, 15 bp, Homo sapiens
cttgtaaaccccatt

SEQ ID NO: 51573 - DNA, 15 bp, Homo sapiens
ttgtaaaccccattt

SEQ ID NO: 51574 - DNA, 15 bp, Homo sapiens
tgtaaaccccatttt

SEQ ID NO: 51575 - DNA, 15 bp, Homo sapiens
gtaaaccccattttg

SEQ ID NO: 51576 - DNA, 15 bp, Homo sapiens
taaaccccattttgc

SEQ ID NO: 51577 - DNA, 15 bp, Homo sapiens
aaaccccattttgcc

SEQ ID NO: 51578 - DNA, 15 bp, Homo sapiens
aaccccattttgcct

SEQ ID NO: 51579 - DNA, 15 bp, Homo sapiens
accccattttgcctc

SEQ ID NO: 51580 - DNA, 15 bp, Homo sapiens
ccccattttgcctct

SEQ ID NO: 51581 - DNA, 15 bp, Homo sapiens
cccattttgcctctc

SEQ ID NO: 51582 - DNA, 15 bp, Homo sapiens
ccattttgcctctca

SEQ ID NO: 51583 - DNA, 15 bp, Homo sapiens
cattttgcctctcat

SEQ ID NO: 51584 - DNA, 15 bp, Homo sapiens
attttgcctctcatc

SEQ ID NO: 51585 - DNA, 15 bp, Homo sapiens
ttttgcctctcatct

SEQ ID NO: 51586 - DNA, 15 bp, Homo sapiens
tttgcctctcatcta

SEQ ID NO: 51587 - DNA, 15 bp, Homo sapiens
ttgcctctcatctaa

SEQ ID NO: 51588 - DNA, 15 bp, Homo sapiens
tgcctctcatctaaa

SEQ ID NO: 51589 - DNA, 15 bp, Homo sapiens
gcctctcatctaaat

SEQ ID NO: 51590 - DNA, 15 bp, Homo sapiens
cctctcatctaaatc

SEQ ID NO: 51591 - DNA, 15 bp, Homo sapiens
ctctcatctaaatca

SEQ ID NO: 51592 - DNA, 15 bp, Homo sapiens
tctcatctaaatcat

SEQ ID NO: 51593 - DNA, 15 bp, Homo sapiens
ctcatctaaatcatg

SEQ ID NO: 51594 - DNA, 15 bp, Homo sapiens
tcatctaaatcatga

SEQ ID NO: 51595 - DNA, 15 bp, Homo sapiens
catctaaatcatgat

SEQ ID NO: 51596 - DNA, 15 bp, Homo sapiens
atctaaatcatgatt

SEQ ID NO: 51597 - DNA, 15 bp, Homo sapiens
tctaaatcatgattt

SEQ ID NO: 51598 - DNA, 15 bp, Homo sapiens
ctaaatcatgatttt

SEQ ID NO: 51599 - DNA, 15 bp, Homo sapiens
taaatcatgattttt

SEQ ID NO: 51600 - DNA, 15 bp, Homo sapiens
aaatcatgatttttt

SEQ ID NO: 51601 - DNA, 15 bp, Homo sapiens
aatcatgattttttt

SEQ ID NO: 51602 - DNA, 15 bp, Homo sapiens
atcatgatttttttt

SEQ ID NO: 51603 - DNA, 15 bp, Homo sapiens
tcatgatttttttta

SEQ ID NO: 51604 - DNA, 15 bp, Homo sapiens
catgattttttttaa

SEQ ID NO: 51605 - DNA, 15 bp, Homo sapiens
atgattttttttaaa

SEQ ID NO: 51606 - DNA, 15 bp, Homo sapiens
tgattttttttaaat

SEQ ID NO: 51607 - DNA, 15 bp, Homo sapiens
gattttttttaaatt

SEQ ID NO: 51608 - DNA, 15 bp, Homo sapiens
attttttttaaattg

SEQ ID NO: 51609 - DNA, 15 bp, Homo sapiens
ttttttttaaattgg

SEQ ID NO: 51610 - DNA, 15 bp, Homo sapiens
tttttttaaattggt

SEQ ID NO: 51611 - DNA, 15 bp, Homo sapiens
ttttttaaattggtg

SEQ ID NO: 51612 - DNA, 15 bp, Homo sapiens
tttttaaattggtga

SEQ ID NO: 51613 - DNA, 15 bp, Homo sapiens
ttttaaattggtgac

SEQ ID NO: 51614 - DNA, 15 bp, Homo sapiens
tttaaattggtgaca

SEQ ID NO: 51615 - DNA, 15 bp, Homo sapiens
ttaaattggtgacat

SEQ ID NO: 51616 - DNA, 15 bp, Homo sapiens
taaattggtgacatt

SEQ ID NO: 51617 - DNA, 15 bp, Homo sapiens
aaattggtgacattt

SEQ ID NO: 51618 - DNA, 15 bp, Homo sapiens
aattggtgacatttc

SEQ ID NO: 51619 - DNA, 15 bp, Homo sapiens
attggtgacatttct

SEQ ID NO: 51620 - DNA, 15 bp, Homo sapiens
ttggtgacatttcta

SEQ ID NO: 51621 - DNA, 15 bp, Homo sapiens
tggtgacatttctag

SEQ ID NO: 51622 - DNA, 15 bp, Homo sapiens
ggtgacatttctaga

SEQ ID NO: 51623 - DNA, 15 bp, Homo sapiens
gtgacatttctagaa

SEQ ID NO: 51624 - DNA, 15 bp, Homo sapiens
tgacatttctagaat

SEQ ID NO: 51625 - DNA, 15 bp, Homo sapiens
gacatttctagaata

SEQ ID NO: 51626 - DNA, 15 bp, Homo sapiens
acatttctagaatat

SEQ ID NO: 51627 - DNA, 15 bp, Homo sapiens
catttctagaatatt

SEQ ID NO: 51628 - DNA, 15 bp, Homo sapiens
atttctagaatattc

SEQ ID NO: 51629 - DNA, 15 bp, Homo sapiens
tttctagaatattca

SEQ ID NO: 51630 - DNA, 15 bp, Homo sapiens
ttctagaatattcat

SEQ ID NO: 51631 - DNA, 15 bp, Homo sapiens
tctagaatattcatt

SEQ ID NO: 51632 - DNA, 15 bp, Homo sapiens
ctagaatattcatta

SEQ ID NO: 51633 - DNA, 15 bp, Homo sapiens
tagaatattcattag

SEQ ID NO: 51634 - DNA, 15 bp, Homo sapiens
agaatattcattagt

SEQ ID NO: 51635 - DNA, 15 bp, Homo sapiens
gaatattcattagtt

SEQ ID NO: 51636 - DNA, 15 bp, Homo sapiens
aatattcattagtta

SEQ ID NO: 51637 - DNA, 15 bp, Homo sapiens
atattcattagttac

SEQ ID NO: 51638 - DNA, 15 bp, Homo sapiens
tattcattagttact

SEQ ID NO: 51639 - DNA, 15 bp, Homo sapiens
attcattagttactg

SEQ ID NO: 51640 - DNA, 15 bp, Homo sapiens
ttcattagttactga

SEQ ID NO: 51641 - DNA, 15 bp, Homo sapiens
tcattagttactgaa

SEQ ID NO: 51642 - DNA, 15 bp, Homo sapiens
cattagttactgaag

SEQ ID NO: 51643 - DNA, 15 bp, Homo sapiens
attagttactgaagg

SEQ ID NO: 51644 - DNA, 15 bp, Homo sapiens
ttagttactgaaggt

SEQ ID NO: 51645 - DNA, 15 bp, Homo sapiens
tagttactgaaggtc

SEQ ID NO: 51646 - DNA, 15 bp, Homo sapiens
agttactgaaggtca

SEQ ID NO: 51647 - DNA, 15 bp, Homo sapiens
gttactgaaggtcaa

SEQ ID NO: 51648 - DNA, 15 bp, Homo sapiens
ttactgaaggtcaaa

SEQ ID NO: 51649 - DNA, 15 bp, Homo sapiens
tactgaaggtcaaaa

SEQ ID NO: 51650 - DNA, 15 bp, Homo sapiens
actgaaggtcaaaag

SEQ ID NO: 51651 - DNA, 15 bp, Homo sapiens
ctgaaggtcaaaaga

SEQ ID NO: 51652 - DNA, 15 bp, Homo sapiens
tgaaggtcaaaagat

SEQ ID NO: 51653 - DNA, 15 bp, Homo sapiens
gaaggtcaaaagatc

SEQ ID NO: 51654 - DNA, 15 bp, Homo sapiens
aaggtcaaaagatcc

SEQ ID NO: 51655 - DNA, 15 bp, Homo sapiens
aggtcaaaagatcca

SEQ ID NO: 51656 - DNA, 15 bp, Homo sapiens
ggtcaaaagatccaa

SEQ ID NO: 51657 - DNA, 15 bp, Homo sapiens
gtcaaaagatccaag

SEQ ID NO: 51658 - DNA, 15 bp, Homo sapiens
tcaaaagatccaagt

SEQ ID NO: 51659 - DNA, 15 bp, Homo sapiens
caaaagatccaagtt

SEQ ID NO: 51660 - DNA, 15 bp, Homo sapiens
aaaagatccaagttg

SEQ ID NO: 51661 - DNA, 15 bp, Homo sapiens
aaagatccaagttgg

SEQ ID NO: 51662 - DNA, 15 bp, Homo sapiens
aagatccaagttgga

SEQ ID NO: 51663 - DNA, 15 bp, Homo sapiens
agatccaagttggag

SEQ ID NO: 51664 - DNA, 15 bp, Homo sapiens
gatccaagttggaga

SEQ ID NO: 51665 - DNA, 15 bp, Homo sapiens
atccaagttggagat

SEQ ID NO: 51666 - DNA, 15 bp, Homo sapiens
tccaagttggagatt

SEQ ID NO: 51667 - DNA, 15 bp, Homo sapiens
ccaagttggagatta

SEQ ID NO: 51668 - DNA, 15 bp, Homo sapiens
caagttggagattac

SEQ ID NO: 51669 - DNA, 15 bp, Homo sapiens
aagttggagattact

SEQ ID NO: 51670 - DNA, 15 bp, Homo sapiens
agttggagattactt

SEQ ID NO: 51671 - DNA, 15 bp, Homo sapiens
gttggagattacttc

SEQ ID NO: 51672 - DNA, 15 bp, Homo sapiens
ttggagattacttcc

SEQ ID NO: 51673 - DNA, 15 bp, Homo sapiens
tggagattacttcca

SEQ ID NO: 51674 - DNA, 15 bp, Homo sapiens
ggagattacttccac

SEQ ID NO: 51675 - DNA, 15 bp, Homo sapiens
gagattacttccact

SEQ ID NO: 51676 - DNA, 15 bp, Homo sapiens
agattacttccactt

SEQ ID NO: 51677 - DNA, 15 bp, Homo sapiens
gattacttccacttt

SEQ ID NO: 51678 - DNA, 15 bp, Homo sapiens
attacttccactttt

SEQ ID NO: 51679 - DNA, 15 bp, Homo sapiens
ttacttccacttttc

SEQ ID NO: 51680 - DNA, 15 bp, Homo sapiens
tacttccacttttct

SEQ ID NO: 51681 - DNA, 15 bp, Homo sapiens
acttccacttttcta

SEQ ID NO: 51682 - DNA, 15 bp, Homo sapiens
cttccacttttctac

SEQ ID NO: 51683 - DNA, 15 bp, Homo sapiens
ttccacttttctact

SEQ ID NO: 51684 - DNA, 15 bp, Homo sapiens
tccacttttctactc

SEQ ID NO: 51685 - DNA, 15 bp, Homo sapiens
ccacttttctactca

SEQ ID NO: 51686 - DNA, 15 bp, Homo sapiens
cacttttctactcag

SEQ ID NO: 51687 - DNA, 15 bp, Homo sapiens
acttttctactcaga

SEQ ID NO: 51688 - DNA, 15 bp, Homo sapiens
cttttctactcagag

SEQ ID NO: 51689 - DNA, 15 bp, Homo sapiens
ttttctactcagagt

SEQ ID NO: 51690 - DNA, 15 bp, Homo sapiens
tttctactcagagta

SEQ ID NO: 51691 - DNA, 15 bp, Homo sapiens
ttctactcagagtag

SEQ ID NO: 51692 - DNA, 15 bp, Homo sapiens
tctactcagagtaga

SEQ ID NO: 51693 - DNA, 15 bp, Homo sapiens
ctactcagagtagaa

SEQ ID NO: 51694 - DNA, 15 bp, Homo sapiens
tactcagagtagaat

SEQ ID NO: 51695 - DNA, 15 bp, Homo sapiens
actcagagtagaatt

SEQ ID NO: 51696 - DNA, 15 bp, Homo sapiens
ctcagagtagaattc

SEQ ID NO: 51697 - DNA, 15 bp, Homo sapiens
tcagagtagaattct

SEQ ID NO: 51698 - DNA, 15 bp, Homo sapiens
cagagtagaattctt

SEQ ID NO: 51699 - DNA, 15 bp, Homo sapiens
agagtagaattcttt

SEQ ID NO: 51700 - DNA, 15 bp, Homo sapiens
gagtagaattctttt

SEQ ID NO: 51701 - DNA, 15 bp, Homo sapiens
agtagaattctttta

SEQ ID NO: 51702 - DNA, 15 bp, Homo sapiens
gtagaattcttttat

SEQ ID NO: 51703 - DNA, 15 bp, Homo sapiens
tagaattcttttata

SEQ ID NO: 51704 - DNA, 15 bp, Homo sapiens
agaattcttttatat

SEQ ID NO: 51705 - DNA, 15 bp, Homo sapiens
gaattcttttatatc

SEQ ID NO: 51706 - DNA, 15 bp, Homo sapiens
aattcttttatatca

SEQ ID NO: 51707 - DNA, 15 bp, Homo sapiens
attcttttatatcaa

SEQ ID NO: 51708 - DNA, 15 bp, Homo sapiens
ttcttttatatcaag

SEQ ID NO: 51709 - DNA, 15 bp, Homo sapiens
tcttttatatcaagg

SEQ ID NO: 51710 - DNA, 15 bp, Homo sapiens
cttttatatcaagga

SEQ ID NO: 51711 - DNA, 15 bp, Homo sapiens
ttttatatcaaggat

SEQ ID NO: 51712 - DNA, 15 bp, Homo sapiens
tttatatcaaggatg

SEQ ID NO: 51713 - DNA, 15 bp, Homo sapiens
ttatatcaaggatgt

SEQ ID NO: 51714 - DNA, 15 bp, Homo sapiens
tatatcaaggatgtg

SEQ ID NO: 51715 - DNA, 15 bp, Homo sapiens
atatcaaggatgtga

SEQ ID NO: 51716 - DNA, 15 bp, Homo sapiens
tatcaaggatgtgac

SEQ ID NO: 51717 - DNA, 15 bp, Homo sapiens
atcaaggatgtgaca

SEQ ID NO: 51718 - DNA, 15 bp, Homo sapiens
tcaaggatgtgacat

SEQ ID NO: 51719 - DNA, 15 bp, Homo sapiens
caaggatgtgacatc

SEQ ID NO: 51720 - DNA, 15 bp, Homo sapiens
aaggatgtgacatcc

SEQ ID NO: 51721 - DNA, 15 bp, Homo sapiens
aggatgtgacatcct

SEQ ID NO: 51722 - DNA, 15 bp, Homo sapiens
ggatgtgacatccta

SEQ ID NO: 51723 - DNA, 15 bp, Homo sapiens
gatgtgacatcctaa

SEQ ID NO: 51724 - DNA, 15 bp, Homo sapiens
atgtgacatcctaaa

SEQ ID NO: 51725 - DNA, 15 bp, Homo sapiens
tgtgacatcctaaag

SEQ ID NO: 51726 - DNA, 15 bp, Homo sapiens
gtgacatcctaaagc

SEQ ID NO: 51727 - DNA, 15 bp, Homo sapiens
tgacatcctaaagct

SEQ ID NO: 51728 - DNA, 15 bp, Homo sapiens
gacatcctaaagcta

SEQ ID NO: 51729 - DNA, 15 bp, Homo sapiens
acatcctaaagctat

SEQ ID NO: 51730 - DNA, 15 bp, Homo sapiens
catcctaaagctatg

SEQ ID NO: 51731 - DNA, 15 bp, Homo sapiens
atcctaaagctatga

SEQ ID NO: 51732 - DNA, 15 bp, Homo sapiens
tcctaaagctatgaa

SEQ ID NO: 51733 - DNA, 15 bp, Homo sapiens
cctaaagctatgaac

SEQ ID NO: 51734 - DNA, 15 bp, Homo sapiens
ctaaagctatgaaca

SEQ ID NO: 51735 - DNA, 15 bp, Homo sapiens
taaagctatgaacaa

SEQ ID NO: 51736 - DNA, 15 bp, Homo sapiens
aaagctatgaacaaa

SEQ ID NO: 51737 - DNA, 15 bp, Homo sapiens
aagctatgaacaaaa

SEQ ID NO: 51738 - DNA, 15 bp, Homo sapiens
agctatgaacaaaat

SEQ ID NO: 51739 - DNA, 15 bp, Homo sapiens
gctatgaacaaaatg

SEQ ID NO: 51740 - DNA, 15 bp, Homo sapiens
ctatgaacaaaatga

SEQ ID NO: 51741 - DNA, 15 bp, Homo sapiens
tatgaacaaaatgaa

SEQ ID NO: 51742 - DNA, 15 bp, Homo sapiens
atgaacaaaatgaag

SEQ ID NO: 51743 - DNA, 15 bp, Homo sapiens
tgaacaaaatgaaga

SEQ ID NO: 51744 - DNA, 15 bp, Homo sapiens
gaacaaaatgaagaa

SEQ ID NO: 51745 - DNA, 15 bp, Homo sapiens
aacaaaatgaagaag

SEQ ID NO: 51746 - DNA, 15 bp, Homo sapiens
acaaaatgaagaagc

SEQ ID NO: 51747 - DNA, 15 bp, Homo sapiens
caaaatgaagaagct

SEQ ID NO: 51748 - DNA, 15 bp, Homo sapiens
aaaatgaagaagctt

SEQ ID NO: 51749 - DNA, 15 bp, Homo sapiens
aaatgaagaagcttt

SEQ ID NO: 51750 - DNA, 15 bp, Homo sapiens
aatgaagaagctttg

SEQ ID NO: 51751 - DNA, 15 bp, Homo sapiens
atgaagaagctttgg

SEQ ID NO: 51752 - DNA, 15 bp, Homo sapiens
tgaagaagctttggt

SEQ ID NO: 51753 - DNA, 15 bp, Homo sapiens
gaagaagctttggta

SEQ ID NO: 51754 - DNA, 15 bp, Homo sapiens
aagaagctttggtac

SEQ ID NO: 51755 - DNA, 15 bp, Homo sapiens
agaagctttggtact

SEQ ID NO: 51756 - DNA, 15 bp, Homo sapiens
gaagctttggtactg

SEQ ID NO: 51757 - DNA, 15 bp, Homo sapiens
aagctttggtactgt

SEQ ID NO: 51758 - DNA, 15 bp, Homo sapiens
agctttggtactgtg

SEQ ID NO: 51759 - DNA, 15 bp, Homo sapiens
gctttggtactgtgg

SEQ ID NO: 51760 - DNA, 15 bp, Homo sapiens
ctttggtactgtggg

SEQ ID NO: 51761 - DNA, 15 bp, Homo sapiens
tttggtactgtgggc

SEQ ID NO: 51762 - DNA, 15 bp, Homo sapiens
ttggtactgtgggct

SEQ ID NO: 51763 - DNA, 15 bp, Homo sapiens
tggtactgtgggctc

SEQ ID NO: 51764 - DNA, 15 bp, Homo sapiens
ggtactgtgggctca

SEQ ID NO: 51765 - DNA, 15 bp, Homo sapiens
gtactgtgggctcag

SEQ ID NO: 51766 - DNA, 15 bp, Homo sapiens
tactgtgggctcaga

SEQ ID NO: 51767 - DNA, 15 bp, Homo sapiens
actgtgggctcagaa

SEQ ID NO: 51768 - DNA, 15 bp, Homo sapiens
ctgtgggctcagaat

SEQ ID NO: 51769 - DNA, 15 bp, Homo sapiens
tgtgggctcagaata

SEQ ID NO: 51770 - DNA, 15 bp, Homo sapiens
gtgggctcagaatag

SEQ ID NO: 51771 - DNA, 15 bp, Homo sapiens
tgggctcagaatagc

SEQ ID NO: 51772 - DNA, 15 bp, Homo sapiens
gggctcagaatagca

SEQ ID NO: 51773 - DNA, 15 bp, Homo sapiens
ggctcagaatagcac

SEQ ID NO: 51774 - DNA, 15 bp, Homo sapiens
gctcagaatagcaca

SEQ ID NO: 51775 - DNA, 15 bp, Homo sapiens
ctcagaatagcacaa

SEQ ID NO: 51776 - DNA, 15 bp, Homo sapiens
tcagaatagcacaag

SEQ ID NO: 51777 - DNA, 15 bp, Homo sapiens
cagaatagcacaaga

SEQ ID NO: 51778 - DNA, 15 bp, Homo sapiens
agaatagcacaagag

SEQ ID NO: 51779 - DNA, 15 bp, Homo sapiens
gaatagcacaagagt

SEQ ID NO: 51780 - DNA, 15 bp, Homo sapiens
aatagcacaagagtt

SEQ ID NO: 51781 - DNA, 15 bp, Homo sapiens
atagcacaagagtta

SEQ ID NO: 51782 - DNA, 15 bp, Homo sapiens
tagcacaagagttaa

SEQ ID NO: 51783 - DNA, 15 bp, Homo sapiens
agcacaagagttaaa

SEQ ID NO: 51784 - DNA, 15 bp, Homo sapiens
gcacaagagttaaag

SEQ ID NO: 51785 - DNA, 15 bp, Homo sapiens
cacaagagttaaaga

SEQ ID NO: 51786 - DNA, 15 bp, Homo sapiens
acaagagttaaagaa

SEQ ID NO: 51787 - DNA, 15 bp, Homo sapiens
caagagttaaagaat

SEQ ID NO: 51788 - DNA, 15 bp, Homo sapiens
aagagttaaagaatg

SEQ ID NO: 51789 - DNA, 15 bp, Homo sapiens
agagttaaagaatgg

SEQ ID NO: 51790 - DNA, 15 bp, Homo sapiens
gagttaaagaatggt

SEQ ID NO: 51791 - DNA, 15 bp, Homo sapiens
agttaaagaatggtt

SEQ ID NO: 51792 - DNA, 15 bp, Homo sapiens
gttaaagaatggttt

SEQ ID NO: 51793 - DNA, 15 bp, Homo sapiens
ttaaagaatggtttg

SEQ ID NO: 51794 - DNA, 15 bp, Homo sapiens
taaagaatggtttga

SEQ ID NO: 51795 - DNA, 15 bp, Homo sapiens
aaagaatggtttgat

SEQ ID NO: 51796 - DNA, 15 bp, Homo sapiens
aagaatggtttgata

SEQ ID NO: 51797 - DNA, 15 bp, Homo sapiens
agaatggtttgataa

SEQ ID NO: 51798 - DNA, 15 bp, Homo sapiens
gaatggtttgataac

SEQ ID NO: 51799 - DNA, 15 bp, Homo sapiens
aatggtttgataacg

SEQ ID NO: 51800 - DNA, 15 bp, Homo sapiens
atggtttgataacgg

SEQ ID NO: 51801 - DNA, 15 bp, Homo sapiens
tggtttgataacggg

SEQ ID NO: 51802 - DNA, 15 bp, Homo sapiens
ggtttgataacgggt

SEQ ID NO: 51803 - DNA, 15 bp, Homo sapiens
gtttgataacgggtg

SEQ ID NO: 51804 - DNA, 15 bp, Homo sapiens
tttgataacgggtgt

SEQ ID NO: 51805 - DNA, 15 bp, Homo sapiens
ttgataacgggtgta

SEQ ID NO: 51806 - DNA, 15 bp, Homo sapiens
tgataacgggtgtag

SEQ ID NO: 51807 - DNA, 15 bp, Homo sapiens
gataacgggtgtagt

SEQ ID NO: 51808 - DNA, 15 bp, Homo sapiens
ataacgggtgtagtg

SEQ ID NO: 51809 - DNA, 15 bp, Homo sapiens
taacgggtgtagtgg

SEQ ID NO: 51810 - DNA, 15 bp, Homo sapiens
aacgggtgtagtggt

SEQ ID NO: 51811 - DNA, 15 bp, Homo sapiens
acgggtgtagtggta

SEQ ID NO: 51812 - DNA, 15 bp, Homo sapiens
cgggtgtagtggtat

SEQ ID NO: 51813 - DNA, 15 bp, Homo sapiens
gggtgtagtggtatt

SEQ ID NO: 51814 - DNA, 15 bp, Homo sapiens
ggtgtagtggtattt

SEQ ID NO: 51815 - DNA, 15 bp, Homo sapiens
gtgtagtggtatttt

SEQ ID NO: 51816 - DNA, 15 bp, Homo sapiens
tgtagtggtattttt

SEQ ID NO: 51817 - DNA, 15 bp, Homo sapiens
gtagtggtatttttt

SEQ ID NO: 51818 - DNA, 15 bp, Homo sapiens
tagtggtattttttt

SEQ ID NO: 51819 - DNA, 15 bp, Homo sapiens
agtggtatttttttt

SEQ ID NO: 51820 - DNA, 15 bp, Homo sapiens
gtggtattttttttt

SEQ ID NO: 51821 - DNA, 15 bp, Homo sapiens
tggtatttttttttc

SEQ ID NO: 51822 - DNA, 15 bp, Homo sapiens
ggtatttttttttct

SEQ ID NO: 51823 - DNA, 15 bp, Homo sapiens
gtatttttttttctc

SEQ ID NO: 51824 - DNA, 15 bp, Homo sapiens
tatttttttttctca

SEQ ID NO: 51825 - DNA, 15 bp, Homo sapiens
atttttttttctcat

SEQ ID NO: 51826 - DNA, 15 bp, Homo sapiens
tttttttttctcata

SEQ ID NO: 51827 - DNA, 15 bp, Homo sapiens
ttttttttctcataa

SEQ ID NO: 51828 - DNA, 15 bp, Homo sapiens
tttttttctcataag

SEQ ID NO: 51829 - DNA, 15 bp, Homo sapiens
ttttttctcataaga

SEQ ID NO: 51830 - DNA, 15 bp, Homo sapiens
tttttctcataagaa

SEQ ID NO: 51831 - DNA, 15 bp, Homo sapiens
ttttctcataagaaa

SEQ ID NO: 51832 - DNA, 15 bp, Homo sapiens
tttctcataagaaaa

SEQ ID NO: 51833 - DNA, 15 bp, Homo sapiens
ttctcataagaaaat

SEQ ID NO: 51834 - DNA, 15 bp, Homo sapiens
tctcataagaaaatg

SEQ ID NO: 51835 - DNA, 15 bp, Homo sapiens
ctcataagaaaatgc

SEQ ID NO: 51836 - DNA, 15 bp, Homo sapiens
tcataagaaaatgca

SEQ ID NO: 51837 - DNA, 15 bp, Homo sapiens
cataagaaaatgcaa

SEQ ID NO: 51838 - DNA, 15 bp, Homo sapiens
ataagaaaatgcaaa

SEQ ID NO: 51839 - DNA, 15 bp, Homo sapiens
taagaaaatgcaaaa

SEQ ID NO: 51840 - DNA, 15 bp, Homo sapiens
aagaaaatgcaaaaa

SEQ ID NO: 51841 - DNA, 15 bp, Homo sapiens
agaaaatgcaaaaac

SEQ ID NO: 51842 - DNA, 15 bp, Homo sapiens
gaaaatgcaaaaacc

SEQ ID NO: 51843 - DNA, 15 bp, Homo sapiens
aaaatgcaaaaaccg

SEQ ID NO: 51844 - DNA, 15 bp, Homo sapiens
aaatgcaaaaaccgc

SEQ ID NO: 51845 - DNA, 15 bp, Homo sapiens
aatgcaaaaaccgcc

SEQ ID NO: 51846 - DNA, 15 bp, Homo sapiens
atgcaaaaaccgcca

SEQ ID NO: 51847 - DNA, 15 bp, Homo sapiens
tgcaaaaaccgccag

SEQ ID NO: 51848 - DNA, 15 bp, Homo sapiens
gcaaaaaccgccagg

SEQ ID NO: 51849 - DNA, 15 bp, Homo sapiens
caaaaaccgccaggc

SEQ ID NO: 51850 - DNA, 15 bp, Homo sapiens
aaaaaccgccaggca

SEQ ID NO: 51851 - DNA, 15 bp, Homo sapiens
aaaaccgccaggcac

SEQ ID NO: 51852 - DNA, 15 bp, Homo sapiens
aaaccgccaggcacg

SEQ ID NO: 51853 - DNA, 15 bp, Homo sapiens
aaccgccaggcacgg

SEQ ID NO: 51854 - DNA, 15 bp, Homo sapiens
accgccaggcacggt

SEQ ID NO: 51855 - DNA, 15 bp, Homo sapiens
ccgccaggcacggtg

SEQ ID NO: 51856 - DNA, 15 bp, Homo sapiens
cgccaggcacggtgg

SEQ ID NO: 51857 - DNA, 15 bp, Homo sapiens
gccaggcacggtggc

SEQ ID NO: 51858 - DNA, 15 bp, Homo sapiens
ccaggcacggtggct

SEQ ID NO: 51859 - DNA, 15 bp, Homo sapiens
caggcacggtggctc

SEQ ID NO: 51860 - DNA, 15 bp, Homo sapiens
aggcacggtggctca

SEQ ID NO: 51861 - DNA, 15 bp, Homo sapiens
ggcacggtggctcaa

SEQ ID NO: 51862 - DNA, 15 bp, Homo sapiens
gcacggtggctcaaa

SEQ ID NO: 51863 - DNA, 15 bp, Homo sapiens
cacggtggctcaaat

SEQ ID NO: 51864 - DNA, 15 bp, Homo sapiens
acggtggctcaaatg

SEQ ID NO: 51865 - DNA, 15 bp, Homo sapiens
cggtggctcaaatgc

SEQ ID NO: 51866 - DNA, 15 bp, Homo sapiens
ggtggctcaaatgcc

SEQ ID NO: 51867 - DNA, 15 bp, Homo sapiens
gtggctcaaatgcct

SEQ ID NO: 51868 - DNA, 15 bp, Homo sapiens
tggctcaaatgcctg

SEQ ID NO: 51869 - DNA, 15 bp, Homo sapiens
ggctcaaatgcctgt

SEQ ID NO: 51870 - DNA, 15 bp, Homo sapiens
gctcaaatgcctgta

SEQ ID NO: 51871 - DNA, 15 bp, Homo sapiens
ctcaaatgcctgtaa

SEQ ID NO: 51872 - DNA, 15 bp, Homo sapiens
tcaaatgcctgtaat

SEQ ID NO: 51873 - DNA, 15 bp, Homo sapiens
caaatgcctgtaatc

SEQ ID NO: 51874 - DNA, 15 bp, Homo sapiens
aaatgcctgtaatct

SEQ ID NO: 51875 - DNA, 15 bp, Homo sapiens
aatgcctgtaatctc

SEQ ID NO: 51876 - DNA, 15 bp, Homo sapiens
aatctcagcactttg

SEQ ID NO: 51877 - DNA, 15 bp, Homo sapiens
atctcagcactttgg

SEQ ID NO: 51878 - DNA, 15 bp, Homo sapiens
tctcagcactttggg

SEQ ID NO: 51879 - DNA, 15 bp, Homo sapiens
ctcagcactttggga

SEQ ID NO: 51880 - DNA, 15 bp, Homo sapiens
tgggaggccgaggct

SEQ ID NO: 51881 - DNA, 15 bp, Homo sapiens
gggaggccgaggctg

SEQ ID NO: 51882 - DNA, 15 bp, Homo sapiens
ggaggccgaggctgg

SEQ ID NO: 51883 - DNA, 15 bp, Homo sapiens
gaggccgaggctggc

SEQ ID NO: 51884 - DNA, 15 bp, Homo sapiens
aggccgaggctggca

SEQ ID NO: 51885 - DNA, 15 bp, Homo sapiens
ggccgaggctggcag

SEQ ID NO: 51886 - DNA, 15 bp, Homo sapiens
gccgaggctggcaga

SEQ ID NO: 51887 - DNA, 15 bp, Homo sapiens
ccgaggctggcagat

SEQ ID NO: 51888 - DNA, 15 bp, Homo sapiens
cgaggctggcagatc

SEQ ID NO: 51889 - DNA, 15 bp, Homo sapiens
gaggctggcagatca

SEQ ID NO: 51890 - DNA, 15 bp, Homo sapiens
aggctggcagatcac

SEQ ID NO: 51891 - DNA, 15 bp, Homo sapiens
ggctggcagatcacc

SEQ ID NO: 51892 - DNA, 15 bp, Homo sapiens
gctggcagatcacct

SEQ ID NO: 51893 - DNA, 15 bp, Homo sapiens
ctggcagatcacctg

SEQ ID NO: 51894 - DNA, 15 bp, Homo sapiens
tggcagatcacctgg

SEQ ID NO: 51895 - DNA, 15 bp, Homo sapiens
ggcagatcacctggg

SEQ ID NO: 51896 - DNA, 15 bp, Homo sapiens
gcagatcacctgggg

SEQ ID NO: 51897 - DNA, 15 bp, Homo sapiens
cagatcacctggggt

SEQ ID NO: 51898 - DNA, 15 bp, Homo sapiens
agatcacctggggtt

SEQ ID NO: 51899 - DNA, 15 bp, Homo sapiens
gatcacctggggttg

SEQ ID NO: 51900 - DNA, 15 bp, Homo sapiens
atcacctggggttgg

SEQ ID NO: 51901 - DNA, 15 bp, Homo sapiens
tcacctggggttggg

SEQ ID NO: 51902 - DNA, 15 bp, Homo sapiens
cacctggggttgggg

SEQ ID NO: 51903 - DNA, 15 bp, Homo sapiens
acctggggttggggg

SEQ ID NO: 51904 - DNA, 15 bp, Homo sapiens
cctggggttgggggt

SEQ ID NO: 51905 - DNA, 15 bp, Homo sapiens
ctggggttgggggtt

SEQ ID NO: 51906 - DNA, 15 bp, Homo sapiens
tggggttgggggttt

SEQ ID NO: 51907 - DNA, 15 bp, Homo sapiens
ggggttgggggtttg

SEQ ID NO: 51908 - DNA, 15 bp, Homo sapiens
gggttgggggtttga

SEQ ID NO: 51909 - DNA, 15 bp, Homo sapiens
ggttgggggtttgag

SEQ ID NO: 51910 - DNA, 15 bp, Homo sapiens
gttgggggtttgaga

SEQ ID NO: 51911 - DNA, 15 bp, Homo sapiens
ttgggggtttgagac

SEQ ID NO: 51912 - DNA, 15 bp, Homo sapiens
tgggggtttgagacc

SEQ ID NO: 51913 - DNA, 15 bp, Homo sapiens
gggggtttgagacca

SEQ ID NO: 51914 - DNA, 15 bp, Homo sapiens
gagaccagcctgacc

SEQ ID NO: 51915 - DNA, 15 bp, Homo sapiens
agaccagcctgacca

SEQ ID NO: 51916 - DNA, 15 bp, Homo sapiens
gaccagcctgaccaa

SEQ ID NO: 51917 - DNA, 15 bp, Homo sapiens
accagcctgaccaac

SEQ ID NO: 51918 - DNA, 15 bp, Homo sapiens
ccagcctgaccaaca

SEQ ID NO: 51919 - DNA, 15 bp, Homo sapiens
cagcctgaccaacat

SEQ ID NO: 51920 - DNA, 15 bp, Homo sapiens
aacatggagaaacca

SEQ ID NO: 51921 - DNA, 15 bp, Homo sapiens
acatggagaaaccac

SEQ ID NO: 51922 - DNA, 15 bp, Homo sapiens
catggagaaaccaca

SEQ ID NO: 51923 - DNA, 15 bp, Homo sapiens
atggagaaaccacat

SEQ ID NO: 51924 - DNA, 15 bp, Homo sapiens
tggagaaaccacatc

SEQ ID NO: 51925 - DNA, 15 bp, Homo sapiens
ggagaaaccacatct

SEQ ID NO: 51926 - DNA, 15 bp, Homo sapiens
gagaaaccacatctc

SEQ ID NO: 51927 - DNA, 15 bp, Homo sapiens
agaaaccacatctct

SEQ ID NO: 51928 - DNA, 15 bp, Homo sapiens
gaaaccacatctcta

SEQ ID NO: 51929 - DNA, 15 bp, Homo sapiens
aaaccacatctctac

SEQ ID NO: 51930 - DNA, 15 bp, Homo sapiens
aaccacatctctact

SEQ ID NO: 51931 - DNA, 15 bp, Homo sapiens
accacatctctacta

SEQ ID NO: 51932 - DNA, 15 bp, Homo sapiens
ccacatctctactaa

SEQ ID NO: 51933 - DNA, 15 bp, Homo sapiens
cacatctctactaaa

SEQ ID NO: 51934 - DNA, 15 bp, Homo sapiens
acatctctactaaaa

SEQ ID NO: 51935 - DNA, 15 bp, Homo sapiens
ctaaaaatacaaaat

SEQ ID NO: 51936 - DNA, 15 bp, Homo sapiens
taaaaatacaaaatt

SEQ ID NO: 51937 - DNA, 15 bp, Homo sapiens
aaaaatacaaaatta

SEQ ID NO: 51938 - DNA, 15 bp, Homo sapiens
aaaatacaaaattag

SEQ ID NO: 51939 - DNA, 15 bp, Homo sapiens
aaatacaaaattagc

SEQ ID NO: 51940 - DNA, 15 bp, Homo sapiens
aatacaaaattagcc

SEQ ID NO: 51941 - DNA, 15 bp, Homo sapiens
atacaaaattagcca

SEQ ID NO: 51942 - DNA, 15 bp, Homo sapiens
tacaaaattagccag

SEQ ID NO: 51943 - DNA, 15 bp, Homo sapiens
acaaaattagccagg

SEQ ID NO: 51944 - DNA, 15 bp, Homo sapiens
caaaattagccaggt

SEQ ID NO: 51945 - DNA, 15 bp, Homo sapiens
ggtgtggtggcgcat

SEQ ID NO: 51946 - DNA, 15 bp, Homo sapiens
gtgtggtggcgcata

SEQ ID NO: 51947 - DNA, 15 bp, Homo sapiens
tgtggtggcgcatac

SEQ ID NO: 51948 - DNA, 15 bp, Homo sapiens
gtggtggcgcatacc

SEQ ID NO: 51949 - DNA, 15 bp, Homo sapiens
tggtggcgcatacct

SEQ ID NO: 51950 - DNA, 15 bp, Homo sapiens
ggtggcgcatacctg

SEQ ID NO: 51951 - DNA, 15 bp, Homo sapiens
gtggcgcatacctgt

SEQ ID NO: 51952 - DNA, 15 bp, Homo sapiens
tggcgcatacctgta

SEQ ID NO: 51953 - DNA, 15 bp, Homo sapiens
ggcgcatacctgtag

SEQ ID NO: 51954 - DNA, 15 bp, Homo sapiens
gcgcatacctgtagt

SEQ ID NO: 51955 - DNA, 15 bp, Homo sapiens
cgcatacctgtagtc

SEQ ID NO: 51956 - DNA, 15 bp, Homo sapiens
gcatacctgtagtcc

SEQ ID NO: 51957 - DNA, 15 bp, Homo sapiens
catacctgtagtccc

SEQ ID NO: 51958 - DNA, 15 bp, Homo sapiens
atacctgtagtccca

SEQ ID NO: 51959 - DNA, 15 bp, Homo sapiens
tacctgtagtcccag

SEQ ID NO: 51960 - DNA, 15 bp, Homo sapiens
gtagtcccagctacc

SEQ ID NO: 51961 - DNA, 15 bp, Homo sapiens
tagtcccagctaccc

SEQ ID NO: 51962 - DNA, 15 bp, Homo sapiens
agtcccagctaccct

SEQ ID NO: 51963 - DNA, 15 bp, Homo sapiens
gtcccagctaccctg

SEQ ID NO: 51964 - DNA, 15 bp, Homo sapiens
tcccagctaccctgg

SEQ ID NO: 51965 - DNA, 15 bp, Homo sapiens
cccagctaccctgga

SEQ ID NO: 51966 - DNA, 15 bp, Homo sapiens
ccagctaccctggag

SEQ ID NO: 51967 - DNA, 15 bp, Homo sapiens
cagctaccctggagg

SEQ ID NO: 51968 - DNA, 15 bp, Homo sapiens
agctaccctggaggc

SEQ ID NO: 51969 - DNA, 15 bp, Homo sapiens
gctaccctggaggct

SEQ ID NO: 51970 - DNA, 15 bp, Homo sapiens
ctaccctggaggctg

SEQ ID NO: 51971 - DNA, 15 bp, Homo sapiens
taccctggaggctga

SEQ ID NO: 51972 - DNA, 15 bp, Homo sapiens
accctggaggctgag

SEQ ID NO: 51973 - DNA, 15 bp, Homo sapiens
ccctggaggctgagg

SEQ ID NO: 51974 - DNA, 15 bp, Homo sapiens
cctggaggctgaggc

SEQ ID NO: 51975 - DNA, 15 bp, Homo sapiens
ctggaggctgaggca

SEQ ID NO: 51976 - DNA, 15 bp, Homo sapiens
tggaggctgaggcag

SEQ ID NO: 51977 - DNA, 15 bp, Homo sapiens
gctgaggcagaagag

SEQ ID NO: 51978 - DNA, 15 bp, Homo sapiens
ctgaggcagaagagt

SEQ ID NO: 51979 - DNA, 15 bp, Homo sapiens
tgaggcagaagagtc

SEQ ID NO: 51980 - DNA, 15 bp, Homo sapiens
gaggcagaagagtct

SEQ ID NO: 51981 - DNA, 15 bp, Homo sapiens
aggcagaagagtctc

SEQ ID NO: 51982 - DNA, 15 bp, Homo sapiens
ggcagaagagtctct

SEQ ID NO: 51983 - DNA, 15 bp, Homo sapiens
gcagaagagtctctt

SEQ ID NO: 51984 - DNA, 15 bp, Homo sapiens
cagaagagtctcttg

SEQ ID NO: 51985 - DNA, 15 bp, Homo sapiens
agaagagtctcttga

SEQ ID NO: 51986 - DNA, 15 bp, Homo sapiens
gaagagtctcttgaa

SEQ ID NO: 51987 - DNA, 15 bp, Homo sapiens
aagagtctcttgaac

SEQ ID NO: 51988 - DNA, 15 bp, Homo sapiens
agagtctcttgaacc

SEQ ID NO: 51989 - DNA, 15 bp, Homo sapiens
gagtctcttgaacct

SEQ ID NO: 51990 - DNA, 15 bp, Homo sapiens
agtctcttgaacctg

SEQ ID NO: 51991 - DNA, 15 bp, Homo sapiens
gtctcttgaacctgg

SEQ ID NO: 51992 - DNA, 15 bp, Homo sapiens
tctcttgaacctggg

SEQ ID NO: 51993 - DNA, 15 bp, Homo sapiens
ctcttgaacctggga

SEQ ID NO: 51994 - DNA, 15 bp, Homo sapiens
tcttgaacctgggag

SEQ ID NO: 51995 - DNA, 15 bp, Homo sapiens
tgggaggcggaggtc

SEQ ID NO: 51996 - DNA, 15 bp, Homo sapiens
gggaggcggaggtcg

SEQ ID NO: 51997 - DNA, 15 bp, Homo sapiens
ggaggcggaggtcgc

SEQ ID NO: 51998 - DNA, 15 bp, Homo sapiens
gaggcggaggtcgca

SEQ ID NO: 51999 - DNA, 15 bp, Homo sapiens
aggcggaggtcgcag

SEQ ID NO: 52000 - DNA, 15 bp, Homo sapiens
ggcggaggtcgcagt

SEQ ID NO: 52001 - DNA, 15 bp, Homo sapiens
gcggaggtcgcagtg

SEQ ID NO: 52002 - DNA, 15 bp, Homo sapiens
cggaggtcgcagtga

SEQ ID NO: 52003 - DNA, 15 bp, Homo sapiens
ggaggtcgcagtgag

SEQ ID NO: 52004 - DNA, 15 bp, Homo sapiens
gaggtcgcagtgagc

SEQ ID NO: 52005 - DNA, 15 bp, Homo sapiens
aggtcgcagtgagct

SEQ ID NO: 52006 - DNA, 15 bp, Homo sapiens
ggtcgcagtgagctg

SEQ ID NO: 52007 - DNA, 15 bp, Homo sapiens
gtcgcagtgagctga

SEQ ID NO: 52008 - DNA, 15 bp, Homo sapiens
tcgcagtgagctgag

SEQ ID NO: 52009 - DNA, 15 bp, Homo sapiens
cgcagtgagctgaga

SEQ ID NO: 52010 - DNA, 15 bp, Homo sapiens
cagtgagctgagatt

SEQ ID NO: 52011 - DNA, 15 bp, Homo sapiens
agtgagctgagattg

SEQ ID NO: 52012 - DNA, 15 bp, Homo sapiens
gtgagctgagattgc

SEQ ID NO: 52013 - DNA, 15 bp, Homo sapiens
tgagctgagattgcg

SEQ ID NO: 52014 - DNA, 15 bp, Homo sapiens
gagctgagattgcgc

SEQ ID NO: 52015 - DNA, 15 bp, Homo sapiens
agctgagattgcgcc

SEQ ID NO: 52016 - DNA, 15 bp, Homo sapiens
gctgagattgcgcca

SEQ ID NO: 52017 - DNA, 15 bp, Homo sapiens
ctgagattgcgccat

SEQ ID NO: 52018 - DNA, 15 bp, Homo sapiens
tgagattgcgccatg

SEQ ID NO: 52019 - DNA, 15 bp, Homo sapiens
gagattgcgccatgg

SEQ ID NO: 52020 - DNA, 15 bp, Homo sapiens
agattgcgccatggc

SEQ ID NO: 52021 - DNA, 15 bp, Homo sapiens
gattgcgccatggca

SEQ ID NO: 52022 - DNA, 15 bp, Homo sapiens
attgcgccatggcac

SEQ ID NO: 52023 - DNA, 15 bp, Homo sapiens
ttgcgccatggcact

SEQ ID NO: 52024 - DNA, 15 bp, Homo sapiens
tgcgccatggcactc

SEQ ID NO: 52025 - DNA, 15 bp, Homo sapiens
gccatggcactccag

SEQ ID NO: 52026 - DNA, 15 bp, Homo sapiens
ccatggcactccagc

SEQ ID NO: 52027 - DNA, 15 bp, Homo sapiens
catggcactccagcc

SEQ ID NO: 52028 - DNA, 15 bp, Homo sapiens
atggcactccagcct

SEQ ID NO: 52029 - DNA, 15 bp, Homo sapiens
tggcactccagcctg

SEQ ID NO: 52030 - DNA, 15 bp, Homo sapiens
ggcactccagcctgg

SEQ ID NO: 52031 - DNA, 15 bp, Homo sapiens
ctgggcaacaagagc

SEQ ID NO: 52032 - DNA, 15 bp, Homo sapiens
tgggcaacaagagcg

SEQ ID NO: 52033 - DNA, 15 bp, Homo sapiens
gggcaacaagagcga

SEQ ID NO: 52034 - DNA, 15 bp, Homo sapiens
ggcaacaagagcgaa

SEQ ID NO: 52035 - DNA, 15 bp, Homo sapiens
gcaacaagagcgaaa

SEQ ID NO: 52036 - DNA, 15 bp, Homo sapiens
caacaagagcgaaac

SEQ ID NO: 52037 - DNA, 15 bp, Homo sapiens
aacaagagcgaaact

SEQ ID NO: 52038 - DNA, 15 bp, Homo sapiens
acaagagcgaaactc

SEQ ID NO: 52039 - DNA, 15 bp, Homo sapiens
caagagcgaaactcc

SEQ ID NO: 52040 - DNA, 15 bp, Homo sapiens
aagagcgaaactccg

SEQ ID NO: 52041 - DNA, 15 bp, Homo sapiens
agagcgaaactccgc

SEQ ID NO: 52042 - DNA, 15 bp, Homo sapiens
gagcgaaactccgcc

SEQ ID NO: 52043 - DNA, 15 bp, Homo sapiens
agcgaaactccgcct

SEQ ID NO: 52044 - DNA, 15 bp, Homo sapiens
gcgaaactccgcctc

SEQ ID NO: 52045 - DNA, 15 bp, Homo sapiens
cgaaactccgcctca

SEQ ID NO: 52046 - DNA, 15 bp, Homo sapiens
gaaactccgcctcaa

SEQ ID NO: 52047 - DNA, 15 bp, Homo sapiens
aaactccgcctcaaa

SEQ ID NO: 52048 - DNA, 15 bp, Homo sapiens
aactccgcctcaaaa

SEQ ID NO: 52049 - DNA, 15 bp, Homo sapiens
gcctcaaaaaaaaaa

SEQ ID NO: 52050 - DNA, 15 bp, Homo sapiens
caaaaaaaaaaaaag

SEQ ID NO: 52051 - DNA, 15 bp, Homo sapiens
aaaaaaaaagaaaaa

SEQ ID NO: 52052 - DNA, 15 bp, Homo sapiens
aaaaaaaagaaaaaa

SEQ ID NO: 52053 - DNA, 15 bp, Homo sapiens
aaaaagaaaaaaaat

SEQ ID NO: 52054 - DNA, 15 bp, Homo sapiens
aaaagaaaaaaaatg

SEQ ID NO: 52055 - DNA, 15 bp, Homo sapiens
aaagaaaaaaaatgc

SEQ ID NO: 52056 - DNA, 15 bp, Homo sapiens
agaaaaaaaatgcag

SEQ ID NO: 52057 - DNA, 15 bp, Homo sapiens
gaaaaaaaatgcaga

SEQ ID NO: 52058 - DNA, 15 bp, Homo sapiens
aaaaaaaatgcagaa

SEQ ID NO: 52059 - DNA, 15 bp, Homo sapiens
aaaaaaatgcagaaa

SEQ ID NO: 52060 - DNA, 15 bp, Homo sapiens
aaaaaatgcagaaac

SEQ ID NO: 52061 - DNA, 15 bp, Homo sapiens
aaaaatgcagaaacc

SEQ ID NO: 52062 - DNA, 15 bp, Homo sapiens
aaaatgcagaaacct

SEQ ID NO: 52063 - DNA, 15 bp, Homo sapiens
aaatgcagaaacctg

SEQ ID NO: 52064 - DNA, 15 bp, Homo sapiens
aatgcagaaacctgt

SEQ ID NO: 52065 - DNA, 15 bp, Homo sapiens
atgcagaaacctgtc

SEQ ID NO: 52066 - DNA, 15 bp, Homo sapiens
tgcagaaacctgtct

SEQ ID NO: 52067 - DNA, 15 bp, Homo sapiens
gcagaaacctgtctc

SEQ ID NO: 52068 - DNA, 15 bp, Homo sapiens
cagaaacctgtctca

SEQ ID NO: 52069 - DNA, 15 bp, Homo sapiens
agaaacctgtctcaa

SEQ ID NO: 52070 - DNA, 15 bp, Homo sapiens
gaaacctgtctcaat

SEQ ID NO: 52071 - DNA, 15 bp, Homo sapiens
aaacctgtctcaatg

SEQ ID NO: 52072 - DNA, 15 bp, Homo sapiens
aacctgtctcaatgt

SEQ ID NO: 52073 - DNA, 15 bp, Homo sapiens
acctgtctcaatgtt

SEQ ID NO: 52074 - DNA, 15 bp, Homo sapiens
cctgtctcaatgttt

SEQ ID NO: 52075 - DNA, 15 bp, Homo sapiens
ctgtctcaatgttta

SEQ ID NO: 52076 - DNA, 15 bp, Homo sapiens
tgtctcaatgtttaa

SEQ ID NO: 52077 - DNA, 15 bp, Homo sapiens
gtctcaatgtttaac

SEQ ID NO: 52078 - DNA, 15 bp, Homo sapiens
tctcaatgtttaact

SEQ ID NO: 52079 - DNA, 15 bp, Homo sapiens
ctcaatgtttaactg

SEQ ID NO: 52080 - DNA, 15 bp, Homo sapiens
tcaatgtttaactgg

SEQ ID NO: 52081 - DNA, 15 bp, Homo sapiens
caatgtttaactggg

SEQ ID NO: 52082 - DNA, 15 bp, Homo sapiens
aatgtttaactgggc

SEQ ID NO: 52083 - DNA, 15 bp, Homo sapiens
atgtttaactgggca

SEQ ID NO: 52084 - DNA, 15 bp, Homo sapiens
tgtttaactgggcat

SEQ ID NO: 52085 - DNA, 15 bp, Homo sapiens
gtttaactgggcatt

SEQ ID NO: 52086 - DNA, 15 bp, Homo sapiens
tttaactgggcattt

SEQ ID NO: 52087 - DNA, 15 bp, Homo sapiens
ttaactgggcatttt

SEQ ID NO: 52088 - DNA, 15 bp, Homo sapiens
taactgggcattttt

SEQ ID NO: 52089 - DNA, 15 bp, Homo sapiens
aactgggcatttttc

SEQ ID NO: 52090 - DNA, 15 bp, Homo sapiens
actgggcatttttca

SEQ ID NO: 52091 - DNA, 15 bp, Homo sapiens
ctgggcatttttcaa

SEQ ID NO: 52092 - DNA, 15 bp, Homo sapiens
tgggcatttttcaaa

SEQ ID NO: 52093 - DNA, 15 bp, Homo sapiens
gggcatttttcaaac

SEQ ID NO: 52094 - DNA, 15 bp, Homo sapiens
ggcatttttcaaact

SEQ ID NO: 52095 - DNA, 15 bp, Homo sapiens
gcatttttcaaacta

SEQ ID NO: 52096 - DNA, 15 bp, Homo sapiens
catttttcaaactag

SEQ ID NO: 52097 - DNA, 15 bp, Homo sapiens
atttttcaaactagg

SEQ ID NO: 52098 - DNA, 15 bp, Homo sapiens
tttttcaaactaggg

SEQ ID NO: 52099 - DNA, 15 bp, Homo sapiens
ttttcaaactagggg

SEQ ID NO: 52100 - DNA, 15 bp, Homo sapiens
tttcaaactagggga

SEQ ID NO: 52101 - DNA, 15 bp, Homo sapiens
ttcaaactaggggac

SEQ ID NO: 52102 - DNA, 15 bp, Homo sapiens
tcaaactaggggaca

SEQ ID NO: 52103 - DNA, 15 bp, Homo sapiens
caaactaggggacaa

SEQ ID NO: 52104 - DNA, 15 bp, Homo sapiens
aaactaggggacaaa

SEQ ID NO: 52105 - DNA, 15 bp, Homo sapiens
aactaggggacaaaa

SEQ ID NO: 52106 - DNA, 15 bp, Homo sapiens
actaggggacaaaaa

SEQ ID NO: 52107 - DNA, 15 bp, Homo sapiens
ctaggggacaaaaac

SEQ ID NO: 52108 - DNA, 15 bp, Homo sapiens
taggggacaaaaact

SEQ ID NO: 52109 - DNA, 15 bp, Homo sapiens
aggggacaaaaacta

SEQ ID NO: 52110 - DNA, 15 bp, Homo sapiens
ggggacaaaaactag

SEQ ID NO: 52111 - DNA, 15 bp, Homo sapiens
gggacaaaaactaga

SEQ ID NO: 52112 - DNA, 15 bp, Homo sapiens
ggacaaaaactagaa

SEQ ID NO: 52113 - DNA, 15 bp, Homo sapiens
gacaaaaactagaac

SEQ ID NO: 52114 - DNA, 15 bp, Homo sapiens
acaaaaactagaact

SEQ ID NO: 52115 - DNA, 15 bp, Homo sapiens
caaaaactagaactt

SEQ ID NO: 52116 - DNA, 15 bp, Homo sapiens
aaaaactagaacttg

SEQ ID NO: 52117 - DNA, 15 bp, Homo sapiens
aaaactagaacttgc

SEQ ID NO: 52118 - DNA, 15 bp, Homo sapiens
aaactagaacttgcc

SEQ ID NO: 52119 - DNA, 15 bp, Homo sapiens
aactagaacttgcca

SEQ ID NO: 52120 - DNA, 15 bp, Homo sapiens
actagaacttgccac

SEQ ID NO: 52121 - DNA, 15 bp, Homo sapiens
ctagaacttgccact

SEQ ID NO: 52122 - DNA, 15 bp, Homo sapiens
tagaacttgccactt

SEQ ID NO: 52123 - DNA, 15 bp, Homo sapiens
agaacttgccacttt

SEQ ID NO: 52124 - DNA, 15 bp, Homo sapiens
gaacttgccactttt

SEQ ID NO: 52125 - DNA, 15 bp, Homo sapiens
aacttgccactttta

SEQ ID NO: 52126 - DNA, 15 bp, Homo sapiens
acttgccacttttat

SEQ ID NO: 52127 - DNA, 15 bp, Homo sapiens
cttgccacttttatt

SEQ ID NO: 52128 - DNA, 15 bp, Homo sapiens
ttgccacttttattt

SEQ ID NO: 52129 - DNA, 15 bp, Homo sapiens
tgccacttttattta

SEQ ID NO: 52130 - DNA, 15 bp, Homo sapiens
gccacttttatttaa

SEQ ID NO: 52131 - DNA, 15 bp, Homo sapiens
ccacttttatttaaa

SEQ ID NO: 52132 - DNA, 15 bp, Homo sapiens
cacttttatttaaag

SEQ ID NO: 52133 - DNA, 15 bp, Homo sapiens
acttttatttaaagt

SEQ ID NO: 52134 - DNA, 15 bp, Homo sapiens
cttttatttaaagtg

SEQ ID NO: 52135 - DNA, 15 bp, Homo sapiens
ttttatttaaagtga

SEQ ID NO: 52136 - DNA, 15 bp, Homo sapiens
tttatttaaagtgat

SEQ ID NO: 52137 - DNA, 15 bp, Homo sapiens
ttatttaaagtgatg

SEQ ID NO: 52138 - DNA, 15 bp, Homo sapiens
tatttaaagtgatgc

SEQ ID NO: 52139 - DNA, 15 bp, Homo sapiens
atttaaagtgatgct

SEQ ID NO: 52140 - DNA, 15 bp, Homo sapiens
tttaaagtgatgctc

SEQ ID NO: 52141 - DNA, 15 bp, Homo sapiens
ttaaagtgatgctct

SEQ ID NO: 52142 - DNA, 15 bp, Homo sapiens
taaagtgatgctctt

SEQ ID NO: 52143 - DNA, 15 bp, Homo sapiens
aaagtgatgctctta

SEQ ID NO: 52144 - DNA, 15 bp, Homo sapiens
aagtgatgctcttat

SEQ ID NO: 52145 - DNA, 15 bp, Homo sapiens
agtgatgctcttatt

SEQ ID NO: 52146 - DNA, 15 bp, Homo sapiens
gtgatgctcttattt

SEQ ID NO: 52147 - DNA, 15 bp, Homo sapiens
tgatgctcttatttt

SEQ ID NO: 52148 - DNA, 15 bp, Homo sapiens
gatgctcttatttta

SEQ ID NO: 52149 - DNA, 15 bp, Homo sapiens
atgctcttattttag

SEQ ID NO: 52150 - DNA, 15 bp, Homo sapiens
tgctcttattttaga

SEQ ID NO: 52151 - DNA, 15 bp, Homo sapiens
gctcttattttagac

SEQ ID NO: 52152 - DNA, 15 bp, Homo sapiens
ctcttattttagacc

SEQ ID NO: 52153 - DNA, 15 bp, Homo sapiens
tcttattttagacca

SEQ ID NO: 52154 - DNA, 15 bp, Homo sapiens
cttattttagaccaa

SEQ ID NO: 52155 - DNA, 15 bp, Homo sapiens
ttattttagaccaat

SEQ ID NO: 52156 - DNA, 15 bp, Homo sapiens
tattttagaccaatc

SEQ ID NO: 52157 - DNA, 15 bp, Homo sapiens
attttagaccaatct

SEQ ID NO: 52158 - DNA, 15 bp, Homo sapiens
ttttagaccaatctg

SEQ ID NO: 52159 - DNA, 15 bp, Homo sapiens
tttagaccaatctga

SEQ ID NO: 52160 - DNA, 15 bp, Homo sapiens
ttagaccaatctgac

SEQ ID NO: 52161 - DNA, 15 bp, Homo sapiens
tagaccaatctgacc

SEQ ID NO: 52162 - DNA, 15 bp, Homo sapiens
agaccaatctgacct

SEQ ID NO: 52163 - DNA, 15 bp, Homo sapiens
gaccaatctgacctt

SEQ ID NO: 52164 - DNA, 15 bp, Homo sapiens
accaatctgaccttc

SEQ ID NO: 52165 - DNA, 15 bp, Homo sapiens
ccaatctgaccttcg

SEQ ID NO: 52166 - DNA, 15 bp, Homo sapiens
caatctgaccttcgt

SEQ ID NO: 52167 - DNA, 15 bp, Homo sapiens
aatctgaccttcgtt

SEQ ID NO: 52168 - DNA, 15 bp, Homo sapiens
atctgaccttcgttg

SEQ ID NO: 52169 - DNA, 15 bp, Homo sapiens
tctgaccttcgttgg

SEQ ID NO: 52170 - DNA, 15 bp, Homo sapiens
ctgaccttcgttggc

SEQ ID NO: 52171 - DNA, 15 bp, Homo sapiens
tgaccttcgttggct

SEQ ID NO: 52172 - DNA, 15 bp, Homo sapiens
gaccttcgttggctg

SEQ ID NO: 52173 - DNA, 15 bp, Homo sapiens
accttcgttggctgc

SEQ ID NO: 52174 - DNA, 15 bp, Homo sapiens
ccttcgttggctgcg

SEQ ID NO: 52175 - DNA, 15 bp, Homo sapiens
cttcgttggctgcgt

SEQ ID NO: 52176 - DNA, 15 bp, Homo sapiens
ttcgttggctgcgtg

SEQ ID NO: 52177 - DNA, 15 bp, Homo sapiens
tcgttggctgcgtgg

SEQ ID NO: 52178 - DNA, 15 bp, Homo sapiens
cgttggctgcgtggg

SEQ ID NO: 52179 - DNA, 15 bp, Homo sapiens
gttggctgcgtgggc

SEQ ID NO: 52180 - DNA, 15 bp, Homo sapiens
ttggctgcgtgggca

SEQ ID NO: 52181 - DNA, 15 bp, Homo sapiens
tggctgcgtgggcat

SEQ ID NO: 52182 - DNA, 15 bp, Homo sapiens
ggctgcgtgggcatg

SEQ ID NO: 52183 - DNA, 15 bp, Homo sapiens
gctgcgtgggcatgc

SEQ ID NO: 52184 - DNA, 15 bp, Homo sapiens
ctgcgtgggcatgct

SEQ ID NO: 52185 - DNA, 15 bp, Homo sapiens
tgcgtgggcatgctg

SEQ ID NO: 52186 - DNA, 15 bp, Homo sapiens
gcgtgggcatgctgg

SEQ ID NO: 52187 - DNA, 15 bp, Homo sapiens
cgtgggcatgctgga

SEQ ID NO: 52188 - DNA, 15 bp, Homo sapiens
gtgggcatgctggat

SEQ ID NO: 52189 - DNA, 15 bp, Homo sapiens
tgggcatgctggatc

SEQ ID NO: 52190 - DNA, 15 bp, Homo sapiens
gggcatgctggatcc

SEQ ID NO: 52191 - DNA, 15 bp, Homo sapiens
ggcatgctggatcct

SEQ ID NO: 52192 - DNA, 15 bp, Homo sapiens
gcatgctggatcctc

SEQ ID NO: 52193 - DNA, 15 bp, Homo sapiens
catgctggatcctcc

SEQ ID NO: 52194 - DNA, 15 bp, Homo sapiens
atgctggatcctccg

SEQ ID NO: 52195 - DNA, 15 bp, Homo sapiens
tgctggatcctccga

SEQ ID NO: 52196 - DNA, 15 bp, Homo sapiens
gctggatcctccgag

SEQ ID NO: 52197 - DNA, 15 bp, Homo sapiens
ctggatcctccgaga

SEQ ID NO: 52198 - DNA, 15 bp, Homo sapiens
tggatcctccgagaa

SEQ ID NO: 52199 - DNA, 15 bp, Homo sapiens
ggatcctccgagaat

SEQ ID NO: 52200 - DNA, 15 bp, Homo sapiens
gatcctccgagaatc

SEQ ID NO: 52201 - DNA, 15 bp, Homo sapiens
atcctccgagaatcg

SEQ ID NO: 52202 - DNA, 15 bp, Homo sapiens
tcctccgagaatcga

SEQ ID NO: 52203 - DNA, 15 bp, Homo sapiens
cctccgagaatcgag

SEQ ID NO: 52204 - DNA, 15 bp, Homo sapiens
ctccgagaatcgagg

SEQ ID NO: 52205 - DNA, 15 bp, Homo sapiens
tccgagaatcgaggt

SEQ ID NO: 52206 - DNA, 15 bp, Homo sapiens
ccgagaatcgaggtg

SEQ ID NO: 52207 - DNA, 15 bp, Homo sapiens
cgagaatcgaggtgg

SEQ ID NO: 52208 - DNA, 15 bp, Homo sapiens
gagaatcgaggtggc

SEQ ID NO: 52209 - DNA, 15 bp, Homo sapiens
agaatcgaggtggcc

SEQ ID NO: 52210 - DNA, 15 bp, Homo sapiens
gaatcgaggtggcct

SEQ ID NO: 52211 - DNA, 15 bp, Homo sapiens
aatcgaggtggcctc

SEQ ID NO: 52212 - DNA, 15 bp, Homo sapiens
atcgaggtggcctcc

SEQ ID NO: 52213 - DNA, 15 bp, Homo sapiens
tcgaggtggcctcct

SEQ ID NO: 52214 - DNA, 15 bp, Homo sapiens
cgaggtggcctcctc

SEQ ID NO: 52215 - DNA, 15 bp, Homo sapiens
gaggtggcctcctcc

SEQ ID NO: 52216 - DNA, 15 bp, Homo sapiens
aggtggcctcctccg

SEQ ID NO: 52217 - DNA, 15 bp, Homo sapiens
ggtggcctcctccgt

SEQ ID NO: 52218 - DNA, 15 bp, Homo sapiens
gtggcctcctccgtg

SEQ ID NO: 52219 - DNA, 15 bp, Homo sapiens
tggcctcctccgtga

SEQ ID NO: 52220 - DNA, 15 bp, Homo sapiens
ggcctcctccgtgaa

SEQ ID NO: 52221 - DNA, 15 bp, Homo sapiens
gcctcctccgtgaag

SEQ ID NO: 52222 - DNA, 15 bp, Homo sapiens
cctcctccgtgaagc

SEQ ID NO: 52223 - DNA, 15 bp, Homo sapiens
ctcctccgtgaagct

SEQ ID NO: 52224 - DNA, 15 bp, Homo sapiens
tcctccgtgaagctg

SEQ ID NO: 52225 - DNA, 15 bp, Homo sapiens
cctccgtgaagctgt

SEQ ID NO: 52226 - DNA, 15 bp, Homo sapiens
ctccgtgaagctgtg

SEQ ID NO: 52227 - DNA, 15 bp, Homo sapiens
tccgtgaagctgtgc

SEQ ID NO: 52228 - DNA, 15 bp, Homo sapiens
ccgtgaagctgtgcc

SEQ ID NO: 52229 - DNA, 15 bp, Homo sapiens
cgtgaagctgtgccg

SEQ ID NO: 52230 - DNA, 15 bp, Homo sapiens
gtgaagctgtgccgg

SEQ ID NO: 52231 - DNA, 15 bp, Homo sapiens
tgaagctgtgccggc

SEQ ID NO: 52232 - DNA, 15 bp, Homo sapiens
gaagctgtgccggca

SEQ ID NO: 52233 - DNA, 15 bp, Homo sapiens
aagctgtgccggcaa

SEQ ID NO: 52234 - DNA, 15 bp, Homo sapiens
agctgtgccggcaag

SEQ ID NO: 52235 - DNA, 15 bp, Homo sapiens
gctgtgccggcaagc

SEQ ID NO: 52236 - DNA, 15 bp, Homo sapiens
ctgtgccggcaagca

SEQ ID NO: 52237 - DNA, 15 bp, Homo sapiens
tgtgccggcaagcag

SEQ ID NO: 52238 - DNA, 15 bp, Homo sapiens
gtgccggcaagcagg

SEQ ID NO: 52239 - DNA, 15 bp, Homo sapiens
tgccggcaagcaggc

SEQ ID NO: 52240 - DNA, 15 bp, Homo sapiens
gccggcaagcaggca

SEQ ID NO: 52241 - DNA, 15 bp, Homo sapiens
ccggcaagcaggcat

SEQ ID NO: 52242 - DNA, 15 bp, Homo sapiens
cggcaagcaggcatc

SEQ ID NO: 52243 - DNA, 15 bp, Homo sapiens
ggcaagcaggcatcc

SEQ ID NO: 52244 - DNA, 15 bp, Homo sapiens
gcaagcaggcatccg

SEQ ID NO: 52245 - DNA, 15 bp, Homo sapiens
caagcaggcatccgg

SEQ ID NO: 52246 - DNA, 15 bp, Homo sapiens
aagcaggcatccggg

SEQ ID NO: 52247 - DNA, 15 bp, Homo sapiens
agcaggcatccgggt

SEQ ID NO: 52248 - DNA, 15 bp, Homo sapiens
gcaggcatccgggtc

SEQ ID NO: 52249 - DNA, 15 bp, Homo sapiens
caggcatccgggtca

SEQ ID NO: 52250 - DNA, 15 bp, Homo sapiens
aggcatccgggtcat

SEQ ID NO: 52251 - DNA, 15 bp, Homo sapiens
ggcatccgggtcatc

SEQ ID NO: 52252 - DNA, 15 bp, Homo sapiens
gcatccgggtcatca

SEQ ID NO: 52253 - DNA, 15 bp, Homo sapiens
catccgggtcatcat

SEQ ID NO: 52254 - DNA, 15 bp, Homo sapiens
atccgggtcatcatg

SEQ ID NO: 52255 - DNA, 15 bp, Homo sapiens
tccgggtcatcatga

SEQ ID NO: 52256 - DNA, 15 bp, Homo sapiens
ccgggtcatcatgat

SEQ ID NO: 52257 - DNA, 15 bp, Homo sapiens
cgggtcatcatgatc

SEQ ID NO: 52258 - DNA, 15 bp, Homo sapiens
gggtcatcatgatca

SEQ ID NO: 52259 - DNA, 15 bp, Homo sapiens
ggtcatcatgatcac

SEQ ID NO: 52260 - DNA, 15 bp, Homo sapiens
gtcatcatgatcact

SEQ ID NO: 52261 - DNA, 15 bp, Homo sapiens
tcatcatgatcactg

SEQ ID NO: 52262 - DNA, 15 bp, Homo sapiens
catcatgatcactgg

SEQ ID NO: 52263 - DNA, 15 bp, Homo sapiens
atcatgatcactggg

SEQ ID NO: 52264 - DNA, 15 bp, Homo sapiens
tcatgatcactgggg

SEQ ID NO: 52265 - DNA, 15 bp, Homo sapiens
catgatcactgggga

SEQ ID NO: 52266 - DNA, 15 bp, Homo sapiens
atgatcactggggac

SEQ ID NO: 52267 - DNA, 15 bp, Homo sapiens
tgatcactggggaca

SEQ ID NO: 52268 - DNA, 15 bp, Homo sapiens
gatcactggggacaa

SEQ ID NO: 52269 - DNA, 15 bp, Homo sapiens
atcactggggacaac

SEQ ID NO: 52270 - DNA, 15 bp, Homo sapiens
tcactggggacaaca

SEQ ID NO: 52271 - DNA, 15 bp, Homo sapiens
cactggggacaacaa

SEQ ID NO: 52272 - DNA, 15 bp, Homo sapiens
actggggacaacaag

SEQ ID NO: 52273 - DNA, 15 bp, Homo sapiens
ctggggacaacaagg

SEQ ID NO: 52274 - DNA, 15 bp, Homo sapiens
tggggacaacaaggg

SEQ ID NO: 52275 - DNA, 15 bp, Homo sapiens
ggggacaacaagggc

SEQ ID NO: 52276 - DNA, 15 bp, Homo sapiens
gggacaacaagggca

SEQ ID NO: 52277 - DNA, 15 bp, Homo sapiens
ggacaacaagggcac

SEQ ID NO: 52278 - DNA, 15 bp, Homo sapiens
gacaacaagggcact

SEQ ID NO: 52279 - DNA, 15 bp, Homo sapiens
acaacaagggcactg

SEQ ID NO: 52280 - DNA, 15 bp, Homo sapiens
caacaagggcactgc

SEQ ID NO: 52281 - DNA, 15 bp, Homo sapiens
aacaagggcactgct

SEQ ID NO: 52282 - DNA, 15 bp, Homo sapiens
acaagggcactgctg

SEQ ID NO: 52283 - DNA, 15 bp, Homo sapiens
caagggcactgctgt

SEQ ID NO: 52284 - DNA, 15 bp, Homo sapiens
aagggcactgctgtg

SEQ ID NO: 52285 - DNA, 15 bp, Homo sapiens
agggcactgctgtgg

SEQ ID NO: 52286 - DNA, 15 bp, Homo sapiens
gggcactgctgtggc

SEQ ID NO: 52287 - DNA, 15 bp, Homo sapiens
ggcactgctgtggcc

SEQ ID NO: 52288 - DNA, 15 bp, Homo sapiens
gcactgctgtggcca

SEQ ID NO: 52289 - DNA, 15 bp, Homo sapiens
cactgctgtggccat

SEQ ID NO: 52290 - DNA, 15 bp, Homo sapiens
actgctgtggccatc

SEQ ID NO: 52291 - DNA, 15 bp, Homo sapiens
ctgctgtggccatct

SEQ ID NO: 52292 - DNA, 15 bp, Homo sapiens
tgctgtggccatctg

SEQ ID NO: 52293 - DNA, 15 bp, Homo sapiens
gctgtggccatctgt

SEQ ID NO: 52294 - DNA, 15 bp, Homo sapiens
ctgtggccatctgtc

SEQ ID NO: 52295 - DNA, 15 bp, Homo sapiens
tgtggccatctgtcg

SEQ ID NO: 52296 - DNA, 15 bp, Homo sapiens
gtggccatctgtcgc

SEQ ID NO: 52297 - DNA, 15 bp, Homo sapiens
tggccatctgtcgcc

SEQ ID NO: 52298 - DNA, 15 bp, Homo sapiens
ggccatctgtcgccg

SEQ ID NO: 52299 - DNA, 15 bp, Homo sapiens
gccatctgtcgccgc

SEQ ID NO: 52300 - DNA, 15 bp, Homo sapiens
ccatctgtcgccgca

SEQ ID NO: 52301 - DNA, 15 bp, Homo sapiens
catctgtcgccgcat

SEQ ID NO: 52302 - DNA, 15 bp, Homo sapiens
atctgtcgccgcatc

SEQ ID NO: 52303 - DNA, 15 bp, Homo sapiens
tctgtcgccgcatcg

SEQ ID NO: 52304 - DNA, 15 bp, Homo sapiens
ctgtcgccgcatcgg

SEQ ID NO: 52305 - DNA, 15 bp, Homo sapiens
tgtcgccgcatcggc

SEQ ID NO: 52306 - DNA, 15 bp, Homo sapiens
gtcgccgcatcggca

SEQ ID NO: 52307 - DNA, 15 bp, Homo sapiens
tcgccgcatcggcat

SEQ ID NO: 52308 - DNA, 15 bp, Homo sapiens
cgccgcatcggcatc

SEQ ID NO: 52309 - DNA, 15 bp, Homo sapiens
gccgcatcggcatct

SEQ ID NO: 52310 - DNA, 15 bp, Homo sapiens
ccgcatcggcatctt

SEQ ID NO: 52311 - DNA, 15 bp, Homo sapiens
cgcatcggcatcttc

SEQ ID NO: 52312 - DNA, 15 bp, Homo sapiens
gcatcggcatcttcg

SEQ ID NO: 52313 - DNA, 15 bp, Homo sapiens
catcggcatcttcgg

SEQ ID NO: 52314 - DNA, 15 bp, Homo sapiens
atcggcatcttcggg

SEQ ID NO: 52315 - DNA, 15 bp, Homo sapiens
tcggcatcttcgggc

SEQ ID NO: 52316 - DNA, 15 bp, Homo sapiens
cggcatcttcgggca

SEQ ID NO: 52317 - DNA, 15 bp, Homo sapiens
ggcatcttcgggcag

SEQ ID NO: 52318 - DNA, 15 bp, Homo sapiens
gcatcttcgggcagg

SEQ ID NO: 52319 - DNA, 15 bp, Homo sapiens
catcttcgggcagga

SEQ ID NO: 52320 - DNA, 15 bp, Homo sapiens
atcttcgggcaggat

SEQ ID NO: 52321 - DNA, 15 bp, Homo sapiens
tcttcgggcaggatg

SEQ ID NO: 52322 - DNA, 15 bp, Homo sapiens
cttcgggcaggatga

SEQ ID NO: 52323 - DNA, 15 bp, Homo sapiens
ttcgggcaggatgag

SEQ ID NO: 52324 - DNA, 15 bp, Homo sapiens
tcgggcaggatgagg

SEQ ID NO: 52325 - DNA, 15 bp, Homo sapiens
cgggcaggatgagga

SEQ ID NO: 52326 - DNA, 15 bp, Homo sapiens
gggcaggatgaggac

SEQ ID NO: 52327 - DNA, 15 bp, Homo sapiens
ggcaggatgaggacg

SEQ ID NO: 52328 - DNA, 15 bp, Homo sapiens
gcaggatgaggacgt

SEQ ID NO: 52329 - DNA, 15 bp, Homo sapiens
caggatgaggacgtg

SEQ ID NO: 52330 - DNA, 15 bp, Homo sapiens
aggatgaggacgtga

SEQ ID NO: 52331 - DNA, 15 bp, Homo sapiens
ggatgaggacgtgac

SEQ ID NO: 52332 - DNA, 15 bp, Homo sapiens
gatgaggacgtgacg

SEQ ID NO: 52333 - DNA, 15 bp, Homo sapiens
atgaggacgtgacgt

SEQ ID NO: 52334 - DNA, 15 bp, Homo sapiens
tgaggacgtgacgtc

SEQ ID NO: 52335 - DNA, 15 bp, Homo sapiens
gaggacgtgacgtca

SEQ ID NO: 52336 - DNA, 15 bp, Homo sapiens
aggacgtgacgtcaa

SEQ ID NO: 52337 - DNA, 15 bp, Homo sapiens
ggacgtgacgtcaaa

SEQ ID NO: 52338 - DNA, 15 bp, Homo sapiens
gacgtgacgtcaaaa

SEQ ID NO: 52339 - DNA, 15 bp, Homo sapiens
acgtgacgtcaaaag

SEQ ID NO: 52340 - DNA, 15 bp, Homo sapiens
cgtgacgtcaaaagc

SEQ ID NO: 52341 - DNA, 15 bp, Homo sapiens
gtgacgtcaaaagct

SEQ ID NO: 52342 - DNA, 15 bp, Homo sapiens
tgacgtcaaaagctt

SEQ ID NO: 52343 - DNA, 15 bp, Homo sapiens
gacgtcaaaagcttt

SEQ ID NO: 52344 - DNA, 15 bp, Homo sapiens
acgtcaaaagctttc

SEQ ID NO: 52345 - DNA, 15 bp, Homo sapiens
cgtcaaaagctttca

SEQ ID NO: 52346 - DNA, 15 bp, Homo sapiens
gtcaaaagctttcac

SEQ ID NO: 52347 - DNA, 15 bp, Homo sapiens
tcaaaagctttcaca

SEQ ID NO: 52348 - DNA, 15 bp, Homo sapiens
caaaagctttcacag

SEQ ID NO: 52349 - DNA, 15 bp, Homo sapiens
aaaagctttcacagg

SEQ ID NO: 52350 - DNA, 15 bp, Homo sapiens
aaagctttcacaggc

SEQ ID NO: 52351 - DNA, 15 bp, Homo sapiens
aagctttcacaggcc

SEQ ID NO: 52352 - DNA, 15 bp, Homo sapiens
agctttcacaggccg

SEQ ID NO: 52353 - DNA, 15 bp, Homo sapiens
gctttcacaggccgg

SEQ ID NO: 52354 - DNA, 15 bp, Homo sapiens
ctttcacaggccggg

SEQ ID NO: 52355 - DNA, 15 bp, Homo sapiens
tttcacaggccggga

SEQ ID NO: 52356 - DNA, 15 bp, Homo sapiens
ttcacaggccgggag

SEQ ID NO: 52357 - DNA, 15 bp, Homo sapiens
tcacaggccgggagt

SEQ ID NO: 52358 - DNA, 15 bp, Homo sapiens
cacaggccgggagtt

SEQ ID NO: 52359 - DNA, 15 bp, Homo sapiens
acaggccgggagttt

SEQ ID NO: 52360 - DNA, 15 bp, Homo sapiens
caggccgggagtttg

SEQ ID NO: 52361 - DNA, 15 bp, Homo sapiens
aggccgggagtttga

SEQ ID NO: 52362 - DNA, 15 bp, Homo sapiens
ggccgggagtttgat

SEQ ID NO: 52363 - DNA, 15 bp, Homo sapiens
gccgggagtttgatg

SEQ ID NO: 52364 - DNA, 15 bp, Homo sapiens
ccgggagtttgatga

SEQ ID NO: 52365 - DNA, 15 bp, Homo sapiens
cgggagtttgatgaa

SEQ ID NO: 52366 - DNA, 15 bp, Homo sapiens
gggagtttgatgaac

SEQ ID NO: 52367 - DNA, 15 bp, Homo sapiens
ggagtttgatgaact

SEQ ID NO: 52368 - DNA, 15 bp, Homo sapiens
gagtttgatgaactc

SEQ ID NO: 52369 - DNA, 15 bp, Homo sapiens
agtttgatgaactca

SEQ ID NO: 52370 - DNA, 15 bp, Homo sapiens
gtttgatgaactcaa

SEQ ID NO: 52371 - DNA, 15 bp, Homo sapiens
tttgatgaactcaac

SEQ ID NO: 52372 - DNA, 15 bp, Homo sapiens
ttgatgaactcaacc

SEQ ID NO: 52373 - DNA, 15 bp, Homo sapiens
tgatgaactcaaccc

SEQ ID NO: 52374 - DNA, 15 bp, Homo sapiens
gatgaactcaacccc

SEQ ID NO: 52375 - DNA, 15 bp, Homo sapiens
atgaactcaacccct

SEQ ID NO: 52376 - DNA, 15 bp, Homo sapiens
tgaactcaacccctc

SEQ ID NO: 52377 - DNA, 15 bp, Homo sapiens
gaactcaacccctcc

SEQ ID NO: 52378 - DNA, 15 bp, Homo sapiens
aactcaacccctccg

SEQ ID NO: 52379 - DNA, 15 bp, Homo sapiens
actcaacccctccgc

SEQ ID NO: 52380 - DNA, 15 bp, Homo sapiens
ctcaacccctccgcc

SEQ ID NO: 52381 - DNA, 15 bp, Homo sapiens
tcaacccctccgccc

SEQ ID NO: 52382 - DNA, 15 bp, Homo sapiens
caacccctccgccca

SEQ ID NO: 52383 - DNA, 15 bp, Homo sapiens
aacccctccgcccag

SEQ ID NO: 52384 - DNA, 15 bp, Homo sapiens
acccctccgcccagc

SEQ ID NO: 52385 - DNA, 15 bp, Homo sapiens
cccctccgcccagcg

SEQ ID NO: 52386 - DNA, 15 bp, Homo sapiens
ccctccgcccagcga

SEQ ID NO: 52387 - DNA, 15 bp, Homo sapiens
cctccgcccagcgag

SEQ ID NO: 52388 - DNA, 15 bp, Homo sapiens
ctccgcccagcgaga

SEQ ID NO: 52389 - DNA, 15 bp, Homo sapiens
tccgcccagcgagac

SEQ ID NO: 52390 - DNA, 15 bp, Homo sapiens
ccgcccagcgagacg

SEQ ID NO: 52391 - DNA, 15 bp, Homo sapiens
cgcccagcgagacgc

SEQ ID NO: 52392 - DNA, 15 bp, Homo sapiens
gcccagcgagacgcc

SEQ ID NO: 52393 - DNA, 15 bp, Homo sapiens
cccagcgagacgcct

SEQ ID NO: 52394 - DNA, 15 bp, Homo sapiens
ccagcgagacgcctg

SEQ ID NO: 52395 - DNA, 15 bp, Homo sapiens
cagcgagacgcctgc

SEQ ID NO: 52396 - DNA, 15 bp, Homo sapiens
agcgagacgcctgcc

SEQ ID NO: 52397 - DNA, 15 bp, Homo sapiens
gcgagacgcctgcct

SEQ ID NO: 52398 - DNA, 15 bp, Homo sapiens
cgagacgcctgcctg

SEQ ID NO: 52399 - DNA, 15 bp, Homo sapiens
gagacgcctgcctga

SEQ ID NO: 52400 - DNA, 15 bp, Homo sapiens
agacgcctgcctgaa

SEQ ID NO: 52401 - DNA, 15 bp, Homo sapiens
gacgcctgcctgaac

SEQ ID NO: 52402 - DNA, 15 bp, Homo sapiens
acgcctgcctgaacg

SEQ ID NO: 52403 - DNA, 15 bp, Homo sapiens
cgcctgcctgaacgc

SEQ ID NO: 52404 - DNA, 15 bp, Homo sapiens
gcctgcctgaacgcc

SEQ ID NO: 52405 - DNA, 15 bp, Homo sapiens
cctgcctgaacgccc

SEQ ID NO: 52406 - DNA, 15 bp, Homo sapiens
ctgcctgaacgcccg

SEQ ID NO: 52407 - DNA, 15 bp, Homo sapiens
tgcctgaacgcccgc

SEQ ID NO: 52408 - DNA, 15 bp, Homo sapiens
gcctgaacgcccgct

SEQ ID NO: 52409 - DNA, 15 bp, Homo sapiens
cctgaacgcccgctg

SEQ ID NO: 52410 - DNA, 15 bp, Homo sapiens
ctgaacgcccgctgt

SEQ ID NO: 52411 - DNA, 15 bp, Homo sapiens
tgaacgcccgctgtt

SEQ ID NO: 52412 - DNA, 15 bp, Homo sapiens
gaacgcccgctgttt

SEQ ID NO: 52413 - DNA, 15 bp, Homo sapiens
aacgcccgctgtttt

SEQ ID NO: 52414 - DNA, 15 bp, Homo sapiens
acgcccgctgttttg

SEQ ID NO: 52415 - DNA, 15 bp, Homo sapiens
cgcccgctgttttgc

SEQ ID NO: 52416 - DNA, 15 bp, Homo sapiens
gcccgctgttttgct

SEQ ID NO: 52417 - DNA, 15 bp, Homo sapiens
cccgctgttttgctc

SEQ ID NO: 52418 - DNA, 15 bp, Homo sapiens
ccgctgttttgctcg

SEQ ID NO: 52419 - DNA, 15 bp, Homo sapiens
cgctgttttgctcga

SEQ ID NO: 52420 - DNA, 15 bp, Homo sapiens
gctgttttgctcgag

SEQ ID NO: 52421 - DNA, 15 bp, Homo sapiens
ctgttttgctcgagt

SEQ ID NO: 52422 - DNA, 15 bp, Homo sapiens
tgttttgctcgagtt

SEQ ID NO: 52423 - DNA, 15 bp, Homo sapiens
gttttgctcgagttg

SEQ ID NO: 52424 - DNA, 15 bp, Homo sapiens
ttttgctcgagttga

SEQ ID NO: 52425 - DNA, 15 bp, Homo sapiens
tttgctcgagttgaa

SEQ ID NO: 52426 - DNA, 15 bp, Homo sapiens
ttgctcgagttgaac

SEQ ID NO: 52427 - DNA, 15 bp, Homo sapiens
tgctcgagttgaacc

SEQ ID NO: 52428 - DNA, 15 bp, Homo sapiens
gctcgagttgaaccc

SEQ ID NO: 52429 - DNA, 15 bp, Homo sapiens
ctcgagttgaaccct

SEQ ID NO: 52430 - DNA, 15 bp, Homo sapiens
tcgagttgaaccctc

SEQ ID NO: 52431 - DNA, 15 bp, Homo sapiens
cgagttgaaccctcc

SEQ ID NO: 52432 - DNA, 15 bp, Homo sapiens
gagttgaaccctccc

SEQ ID NO: 52433 - DNA, 15 bp, Homo sapiens
agttgaaccctccca

SEQ ID NO: 52434 - DNA, 15 bp, Homo sapiens
gttgaaccctcccac

SEQ ID NO: 52435 - DNA, 15 bp, Homo sapiens
ttgaaccctcccaca

SEQ ID NO: 52436 - DNA, 15 bp, Homo sapiens
tgaaccctcccacaa

SEQ ID NO: 52437 - DNA, 15 bp, Homo sapiens
gaaccctcccacaag

SEQ ID NO: 52438 - DNA, 15 bp, Homo sapiens
aaccctcccacaagt

SEQ ID NO: 52439 - DNA, 15 bp, Homo sapiens
accctcccacaagtc

SEQ ID NO: 52440 - DNA, 15 bp, Homo sapiens
ccctcccacaagtct

SEQ ID NO: 52441 - DNA, 15 bp, Homo sapiens
cctcccacaagtcta

SEQ ID NO: 52442 - DNA, 15 bp, Homo sapiens
ctcccacaagtctaa

SEQ ID NO: 52443 - DNA, 15 bp, Homo sapiens
tcccacaagtctaaa

SEQ ID NO: 52444 - DNA, 15 bp, Homo sapiens
cccacaagtctaaaa

SEQ ID NO: 52445 - DNA, 15 bp, Homo sapiens
ccacaagtctaaaat

SEQ ID NO: 52446 - DNA, 15 bp, Homo sapiens
cacaagtctaaaatc

SEQ ID NO: 52447 - DNA, 15 bp, Homo sapiens
acaagtctaaaatcg

SEQ ID NO: 52448 - DNA, 15 bp, Homo sapiens
caagtctaaaatcgt

SEQ ID NO: 52449 - DNA, 15 bp, Homo sapiens
aagtctaaaatcgta

SEQ ID NO: 52450 - DNA, 15 bp, Homo sapiens
agtctaaaatcgtag

SEQ ID NO: 52451 - DNA, 15 bp, Homo sapiens
gtctaaaatcgtaga

SEQ ID NO: 52452 - DNA, 15 bp, Homo sapiens
tctaaaatcgtagaa

SEQ ID NO: 52453 - DNA, 15 bp, Homo sapiens
ctaaaatcgtagaat

SEQ ID NO: 52454 - DNA, 15 bp, Homo sapiens
taaaatcgtagaatt

SEQ ID NO: 52455 - DNA, 15 bp, Homo sapiens
aaaatcgtagaattt

SEQ ID NO: 52456 - DNA, 15 bp, Homo sapiens
aaatcgtagaatttc

SEQ ID NO: 52457 - DNA, 15 bp, Homo sapiens
aatcgtagaatttct

SEQ ID NO: 52458 - DNA, 15 bp, Homo sapiens
atcgtagaatttctt

SEQ ID NO: 52459 - DNA, 15 bp, Homo sapiens
tcgtagaatttcttc

SEQ ID NO: 52460 - DNA, 15 bp, Homo sapiens
cgtagaatttcttca

SEQ ID NO: 52461 - DNA, 15 bp, Homo sapiens
gtagaatttcttcag

SEQ ID NO: 52462 - DNA, 15 bp, Homo sapiens
tagaatttcttcagt

SEQ ID NO: 52463 - DNA, 15 bp, Homo sapiens
agaatttcttcagtc

SEQ ID NO: 52464 - DNA, 15 bp, Homo sapiens
gaatttcttcagtct

SEQ ID NO: 52465 - DNA, 15 bp, Homo sapiens
aatttcttcagtctt

SEQ ID NO: 52466 - DNA, 15 bp, Homo sapiens
atttcttcagtcttt

SEQ ID NO: 52467 - DNA, 15 bp, Homo sapiens
tttcttcagtctttt

SEQ ID NO: 52468 - DNA, 15 bp, Homo sapiens
ttcttcagtcttttg

SEQ ID NO: 52469 - DNA, 15 bp, Homo sapiens
tcttcagtcttttga

SEQ ID NO: 52470 - DNA, 15 bp, Homo sapiens
cttcagtcttttgat

SEQ ID NO: 52471 - DNA, 15 bp, Homo sapiens
ttcagtcttttgatg

SEQ ID NO: 52472 - DNA, 15 bp, Homo sapiens
tcagtcttttgatga

SEQ ID NO: 52473 - DNA, 15 bp, Homo sapiens
cagtcttttgatgag

SEQ ID NO: 52474 - DNA, 15 bp, Homo sapiens
agtcttttgatgaga

SEQ ID NO: 52475 - DNA, 15 bp, Homo sapiens
gtcttttgatgagat

SEQ ID NO: 52476 - DNA, 15 bp, Homo sapiens
tcttttgatgagatt

SEQ ID NO: 52477 - DNA, 15 bp, Homo sapiens
cttttgatgagatta

SEQ ID NO: 52478 - DNA, 15 bp, Homo sapiens
ttttgatgagattac

SEQ ID NO: 52479 - DNA, 15 bp, Homo sapiens
tttgatgagattaca

SEQ ID NO: 52480 - DNA, 15 bp, Homo sapiens
ttgatgagattacag

SEQ ID NO: 52481 - DNA, 15 bp, Homo sapiens
tgatgagattacagc

SEQ ID NO: 52482 - DNA, 15 bp, Homo sapiens
gatgagattacagct

SEQ ID NO: 52483 - DNA, 15 bp, Homo sapiens
atgagattacagcta

SEQ ID NO: 52484 - DNA, 15 bp, Homo sapiens
tgagattacagctat

SEQ ID NO: 52485 - DNA, 15 bp, Homo sapiens
gagattacagctatg

SEQ ID NO: 52486 - DNA, 15 bp, Homo sapiens
agattacagctatgg

SEQ ID NO: 52487 - DNA, 15 bp, Homo sapiens
gattacagctatggt

SEQ ID NO: 52488 - DNA, 15 bp, Homo sapiens
attacagctatggtg

SEQ ID NO: 52489 - DNA, 15 bp, Homo sapiens
ttacagctatggtga

SEQ ID NO: 52490 - DNA, 15 bp, Homo sapiens
tacagctatggtgag

SEQ ID NO: 52491 - DNA, 15 bp, Homo sapiens
acagctatggtgagc

SEQ ID NO: 52492 - DNA, 15 bp, Homo sapiens
cagctatggtgagca

SEQ ID NO: 52493 - DNA, 15 bp, Homo sapiens
agctatggtgagcat

SEQ ID NO: 52494 - DNA, 15 bp, Homo sapiens
gctatggtgagcatg

SEQ ID NO: 52495 - DNA, 15 bp, Homo sapiens
ctatggtgagcatgt

SEQ ID NO: 52496 - DNA, 15 bp, Homo sapiens
tatggtgagcatgtt

SEQ ID NO: 52497 - DNA, 15 bp, Homo sapiens
atggtgagcatgttt

SEQ ID NO: 52498 - DNA, 15 bp, Homo sapiens
tggtgagcatgtttg

SEQ ID NO: 52499 - DNA, 15 bp, Homo sapiens
ggtgagcatgtttga

SEQ ID NO: 52500 - DNA, 15 bp, Homo sapiens
gtgagcatgtttgaa

SEQ ID NO: 52501 - DNA, 15 bp, Homo sapiens
tgagcatgtttgaac

SEQ ID NO: 52502 - DNA, 15 bp, Homo sapiens
gagcatgtttgaaca

SEQ ID NO: 52503 - DNA, 15 bp, Homo sapiens
agcatgtttgaacat

SEQ ID NO: 52504 - DNA, 15 bp, Homo sapiens
gcatgtttgaacatg

SEQ ID NO: 52505 - DNA, 15 bp, Homo sapiens
catgtttgaacatgt

SEQ ID NO: 52506 - DNA, 15 bp, Homo sapiens
atgtttgaacatgta

SEQ ID NO: 52507 - DNA, 15 bp, Homo sapiens
tgtttgaacatgtac

SEQ ID NO: 52508 - DNA, 15 bp, Homo sapiens
gtttgaacatgtaca

SEQ ID NO: 52509 - DNA, 15 bp, Homo sapiens
tttgaacatgtacag

SEQ ID NO: 52510 - DNA, 15 bp, Homo sapiens
ttgaacatgtacagg

SEQ ID NO: 52511 - DNA, 15 bp, Homo sapiens
tgaacatgtacaggt

SEQ ID NO: 52512 - DNA, 15 bp, Homo sapiens
gaacatgtacaggtg

SEQ ID NO: 52513 - DNA, 15 bp, Homo sapiens
aacatgtacaggtga

SEQ ID NO: 52514 - DNA, 15 bp, Homo sapiens
acatgtacaggtgac

SEQ ID NO: 52515 - DNA, 15 bp, Homo sapiens
catgtacaggtgact

SEQ ID NO: 52516 - DNA, 15 bp, Homo sapiens
atgtacaggtgactc

SEQ ID NO: 52517 - DNA, 15 bp, Homo sapiens
tgtacaggtgactca

SEQ ID NO: 52518 - DNA, 15 bp, Homo sapiens
gtacaggtgactcag

SEQ ID NO: 52519 - DNA, 15 bp, Homo sapiens
tacaggtgactcagg

SEQ ID NO: 52520 - DNA, 15 bp, Homo sapiens
acaggtgactcaggc

SEQ ID NO: 52521 - DNA, 15 bp, Homo sapiens
caggtgactcaggct

SEQ ID NO: 52522 - DNA, 15 bp, Homo sapiens
aggtgactcaggcta

SEQ ID NO: 52523 - DNA, 15 bp, Homo sapiens
ggtgactcaggctac

SEQ ID NO: 52524 - DNA, 15 bp, Homo sapiens
gtgactcaggctaca

SEQ ID NO: 52525 - DNA, 15 bp, Homo sapiens
tgactcaggctacac

SEQ ID NO: 52526 - DNA, 15 bp, Homo sapiens
gactcaggctacaca

SEQ ID NO: 52527 - DNA, 15 bp, Homo sapiens
actcaggctacacaa

SEQ ID NO: 52528 - DNA, 15 bp, Homo sapiens
ctcaggctacacaag

SEQ ID NO: 52529 - DNA, 15 bp, Homo sapiens
tcaggctacacaagc

SEQ ID NO: 52530 - DNA, 15 bp, Homo sapiens
caggctacacaagca

SEQ ID NO: 52531 - DNA, 15 bp, Homo sapiens
aggctacacaagcac

SEQ ID NO: 52532 - DNA, 15 bp, Homo sapiens
ggctacacaagcaca

SEQ ID NO: 52533 - DNA, 15 bp, Homo sapiens
gctacacaagcacat

SEQ ID NO: 52534 - DNA, 15 bp, Homo sapiens
ctacacaagcacata

SEQ ID NO: 52535 - DNA, 15 bp, Homo sapiens
tacacaagcacatag

SEQ ID NO: 52536 - DNA, 15 bp, Homo sapiens
acacaagcacatagt

SEQ ID NO: 52537 - DNA, 15 bp, Homo sapiens
cacaagcacatagta

SEQ ID NO: 52538 - DNA, 15 bp, Homo sapiens
acaagcacatagtag

SEQ ID NO: 52539 - DNA, 15 bp, Homo sapiens
caagcacatagtagc

SEQ ID NO: 52540 - DNA, 15 bp, Homo sapiens
aagcacatagtagcc

SEQ ID NO: 52541 - DNA, 15 bp, Homo sapiens
agcacatagtagcct

SEQ ID NO: 52542 - DNA, 15 bp, Homo sapiens
gcacatagtagcctc

SEQ ID NO: 52543 - DNA, 15 bp, Homo sapiens
cacatagtagcctct

SEQ ID NO: 52544 - DNA, 15 bp, Homo sapiens
acatagtagcctcta

SEQ ID NO: 52545 - DNA, 15 bp, Homo sapiens
catagtagcctctaa

SEQ ID NO: 52546 - DNA, 15 bp, Homo sapiens
atagtagcctctaat

SEQ ID NO: 52547 - DNA, 15 bp, Homo sapiens
tagtagcctctaatt

SEQ ID NO: 52548 - DNA, 15 bp, Homo sapiens
agtagcctctaattt

SEQ ID NO: 52549 - DNA, 15 bp, Homo sapiens
gtagcctctaatttt

SEQ ID NO: 52550 - DNA, 15 bp, Homo sapiens
tagcctctaattttg

SEQ ID NO: 52551 - DNA, 15 bp, Homo sapiens
agcctctaattttga

SEQ ID NO: 52552 - DNA, 15 bp, Homo sapiens
gcctctaattttgac

SEQ ID NO: 52553 - DNA, 15 bp, Homo sapiens
cctctaattttgacc

SEQ ID NO: 52554 - DNA, 15 bp, Homo sapiens
ctctaattttgacca

SEQ ID NO: 52555 - DNA, 15 bp, Homo sapiens
tctaattttgaccac

SEQ ID NO: 52556 - DNA, 15 bp, Homo sapiens
ctaattttgaccact

SEQ ID NO: 52557 - DNA, 15 bp, Homo sapiens
taattttgaccactg

SEQ ID NO: 52558 - DNA, 15 bp, Homo sapiens
aattttgaccactga

SEQ ID NO: 52559 - DNA, 15 bp, Homo sapiens
attttgaccactgaa

SEQ ID NO: 52560 - DNA, 15 bp, Homo sapiens
ttttgaccactgaat

SEQ ID NO: 52561 - DNA, 15 bp, Homo sapiens
tttgaccactgaatt

SEQ ID NO: 52562 - DNA, 15 bp, Homo sapiens
ttgaccactgaattt

SEQ ID NO: 52563 - DNA, 15 bp, Homo sapiens
tgaccactgaatttt

SEQ ID NO: 52564 - DNA, 15 bp, Homo sapiens
gaccactgaattttt

SEQ ID NO: 52565 - DNA, 15 bp, Homo sapiens
accactgaatttttt

SEQ ID NO: 52566 - DNA, 15 bp, Homo sapiens
ccactgaattttttt

SEQ ID NO: 52567 - DNA, 15 bp, Homo sapiens
cactgaatttttttg

SEQ ID NO: 52568 - DNA, 15 bp, Homo sapiens
actgaatttttttgt

SEQ ID NO: 52569 - DNA, 15 bp, Homo sapiens
ctgaatttttttgtc

SEQ ID NO: 52570 - DNA, 15 bp, Homo sapiens
tgaatttttttgtca

SEQ ID NO: 52571 - DNA, 15 bp, Homo sapiens
gaatttttttgtcat

SEQ ID NO: 52572 - DNA, 15 bp, Homo sapiens
aatttttttgtcata

SEQ ID NO: 52573 - DNA, 15 bp, Homo sapiens
atttttttgtcatag

SEQ ID NO: 52574 - DNA, 15 bp, Homo sapiens
tttttttgtcatagc

SEQ ID NO: 52575 - DNA, 15 bp, Homo sapiens
ttttttgtcatagct

SEQ ID NO: 52576 - DNA, 15 bp, Homo sapiens
tttttgtcatagctc

SEQ ID NO: 52577 - DNA, 15 bp, Homo sapiens
ttttgtcatagctcc

SEQ ID NO: 52578 - DNA, 15 bp, Homo sapiens
tttgtcatagctccc

SEQ ID NO: 52579 - DNA, 15 bp, Homo sapiens
ttgtcatagctccct

SEQ ID NO: 52580 - DNA, 15 bp, Homo sapiens
tgtcatagctcccta

SEQ ID NO: 52581 - DNA, 15 bp, Homo sapiens
gtcatagctccctaa

SEQ ID NO: 52582 - DNA, 15 bp, Homo sapiens
tcatagctccctaat

SEQ ID NO: 52583 - DNA, 15 bp, Homo sapiens
catagctccctaatt

SEQ ID NO: 52584 - DNA, 15 bp, Homo sapiens
atagctccctaattt

SEQ ID NO: 52585 - DNA, 15 bp, Homo sapiens
tagctccctaatttg

SEQ ID NO: 52586 - DNA, 15 bp, Homo sapiens
agctccctaatttgg

SEQ ID NO: 52587 - DNA, 15 bp, Homo sapiens
gctccctaatttgga

SEQ ID NO: 52588 - DNA, 15 bp, Homo sapiens
ctccctaatttggaa

SEQ ID NO: 52589 - DNA, 15 bp, Homo sapiens
tccctaatttggaat

SEQ ID NO: 52590 - DNA, 15 bp, Homo sapiens
ccctaatttggaatt

SEQ ID NO: 52591 - DNA, 15 bp, Homo sapiens
cctaatttggaattt

SEQ ID NO: 52592 - DNA, 15 bp, Homo sapiens
ctaatttggaatttg

SEQ ID NO: 52593 - DNA, 15 bp, Homo sapiens
taatttggaatttgt

SEQ ID NO: 52594 - DNA, 15 bp, Homo sapiens
aatttggaatttgtc

SEQ ID NO: 52595 - DNA, 15 bp, Homo sapiens
atttggaatttgtca

SEQ ID NO: 52596 - DNA, 15 bp, Homo sapiens
tttggaatttgtcat

SEQ ID NO: 52597 - DNA, 15 bp, Homo sapiens
ttggaatttgtcatg

SEQ ID NO: 52598 - DNA, 15 bp, Homo sapiens
tggaatttgtcatga

SEQ ID NO: 52599 - DNA, 15 bp, Homo sapiens
ggaatttgtcatgat

SEQ ID NO: 52600 - DNA, 15 bp, Homo sapiens
gaatttgtcatgatt

SEQ ID NO: 52601 - DNA, 15 bp, Homo sapiens
aatttgtcatgattt

SEQ ID NO: 52602 - DNA, 15 bp, Homo sapiens
atttgtcatgatttg

SEQ ID NO: 52603 - DNA, 15 bp, Homo sapiens
tttgtcatgatttgg

SEQ ID NO: 52604 - DNA, 15 bp, Homo sapiens
ttgtcatgatttggg

SEQ ID NO: 52605 - DNA, 15 bp, Homo sapiens
tgtcatgatttgggt

SEQ ID NO: 52606 - DNA, 15 bp, Homo sapiens
gtcatgatttgggtc

SEQ ID NO: 52607 - DNA, 15 bp, Homo sapiens
tcatgatttgggtct

SEQ ID NO: 52608 - DNA, 15 bp, Homo sapiens
catgatttgggtctt

SEQ ID NO: 52609 - DNA, 15 bp, Homo sapiens
atgatttgggtcttt

SEQ ID NO: 52610 - DNA, 15 bp, Homo sapiens
tgatttgggtctttt

SEQ ID NO: 52611 - DNA, 15 bp, Homo sapiens
gatttgggtcttttc

SEQ ID NO: 52612 - DNA, 15 bp, Homo sapiens
atttgggtcttttct

SEQ ID NO: 52613 - DNA, 15 bp, Homo sapiens
tttgggtcttttctc

SEQ ID NO: 52614 - DNA, 15 bp, Homo sapiens
ttgggtcttttctct

SEQ ID NO: 52615 - DNA, 15 bp, Homo sapiens
tgggtcttttctcta

SEQ ID NO: 52616 - DNA, 15 bp, Homo sapiens
gggtcttttctctag

SEQ ID NO: 52617 - DNA, 15 bp, Homo sapiens
ggtcttttctctaga

SEQ ID NO: 52618 - DNA, 15 bp, Homo sapiens
gtcttttctctagaa

SEQ ID NO: 52619 - DNA, 15 bp, Homo sapiens
tcttttctctagaat

SEQ ID NO: 52620 - DNA, 15 bp, Homo sapiens
cttttctctagaatt

SEQ ID NO: 52621 - DNA, 15 bp, Homo sapiens
ttttctctagaattc

SEQ ID NO: 52622 - DNA, 15 bp, Homo sapiens
tttctctagaattcg

SEQ ID NO: 52623 - DNA, 15 bp, Homo sapiens
ttctctagaattcgg

SEQ ID NO: 52624 - DNA, 15 bp, Homo sapiens
tctctagaattcggt

SEQ ID NO: 52625 - DNA, 15 bp, Homo sapiens
ctctagaattcggtg

SEQ ID NO: 52626 - DNA, 15 bp, Homo sapiens
tctagaattcggtga

SEQ ID NO: 52627 - DNA, 15 bp, Homo sapiens
ctagaattcggtgaa

SEQ ID NO: 52628 - DNA, 15 bp, Homo sapiens
tagaattcggtgaat

SEQ ID NO: 52629 - DNA, 15 bp, Homo sapiens
agaattcggtgaatc

SEQ ID NO: 52630 - DNA, 15 bp, Homo sapiens
gaattcggtgaatca

SEQ ID NO: 52631 - DNA, 15 bp, Homo sapiens
aattcggtgaatcag

SEQ ID NO: 52632 - DNA, 15 bp, Homo sapiens
attcggtgaatcagt

SEQ ID NO: 52633 - DNA, 15 bp, Homo sapiens
ttcggtgaatcagtg

SEQ ID NO: 52634 - DNA, 15 bp, Homo sapiens
tcggtgaatcagtgg

SEQ ID NO: 52635 - DNA, 15 bp, Homo sapiens
cggtgaatcagtggt

SEQ ID NO: 52636 - DNA, 15 bp, Homo sapiens
ggtgaatcagtggtt

SEQ ID NO: 52637 - DNA, 15 bp, Homo sapiens
gtgaatcagtggtta

SEQ ID NO: 52638 - DNA, 15 bp, Homo sapiens
tgaatcagtggttag

SEQ ID NO: 52639 - DNA, 15 bp, Homo sapiens
gaatcagtggttagc

SEQ ID NO: 52640 - DNA, 15 bp, Homo sapiens
aatcagtggttagca

SEQ ID NO: 52641 - DNA, 15 bp, Homo sapiens
atcagtggttagcat

SEQ ID NO: 52642 - DNA, 15 bp, Homo sapiens
tcagtggttagcatg

SEQ ID NO: 52643 - DNA, 15 bp, Homo sapiens
cagtggttagcatgt

SEQ ID NO: 52644 - DNA, 15 bp, Homo sapiens
agtggttagcatgtt

SEQ ID NO: 52645 - DNA, 15 bp, Homo sapiens
gtggttagcatgttg

SEQ ID NO: 52646 - DNA, 15 bp, Homo sapiens
tggttagcatgttgt

SEQ ID NO: 52647 - DNA, 15 bp, Homo sapiens
ggttagcatgttgtg

SEQ ID NO: 52648 - DNA, 15 bp, Homo sapiens
gttagcatgttgtgt

SEQ ID NO: 52649 - DNA, 15 bp, Homo sapiens
ttagcatgttgtgtg

SEQ ID NO: 52650 - DNA, 15 bp, Homo sapiens
tagcatgttgtgtgc

SEQ ID NO: 52651 - DNA, 15 bp, Homo sapiens
agcatgttgtgtgct

SEQ ID NO: 52652 - DNA, 15 bp, Homo sapiens
gcatgttgtgtgcta

SEQ ID NO: 52653 - DNA, 15 bp, Homo sapiens
catgttgtgtgctac

SEQ ID NO: 52654 - DNA, 15 bp, Homo sapiens
atgttgtgtgctact

SEQ ID NO: 52655 - DNA, 15 bp, Homo sapiens
tgttgtgtgctactt

SEQ ID NO: 52656 - DNA, 15 bp, Homo sapiens
gttgtgtgctacttg

SEQ ID NO: 52657 - DNA, 15 bp, Homo sapiens
ttgtgtgctacttgc

SEQ ID NO: 52658 - DNA, 15 bp, Homo sapiens
tgtgtgctacttgca

SEQ ID NO: 52659 - DNA, 15 bp, Homo sapiens
gtgtgctacttgcag

SEQ ID NO: 52660 - DNA, 15 bp, Homo sapiens
tgtgctacttgcagg

SEQ ID NO: 52661 - DNA, 15 bp, Homo sapiens
gtgctacttgcaggg

SEQ ID NO: 52662 - DNA, 15 bp, Homo sapiens
tgctacttgcaggga

SEQ ID NO: 52663 - DNA, 15 bp, Homo sapiens
gctacttgcagggaa

SEQ ID NO: 52664 - DNA, 15 bp, Homo sapiens
ctacttgcagggaag

SEQ ID NO: 52665 - DNA, 15 bp, Homo sapiens
tacttgcagggaaga

SEQ ID NO: 52666 - DNA, 15 bp, Homo sapiens
acttgcagggaagat

SEQ ID NO: 52667 - DNA, 15 bp, Homo sapiens
cttgcagggaagatc

SEQ ID NO: 52668 - DNA, 15 bp, Homo sapiens
ttgcagggaagatcc

SEQ ID NO: 52669 - DNA, 15 bp, Homo sapiens
tgcagggaagatcct

SEQ ID NO: 52670 - DNA, 15 bp, Homo sapiens
gcagggaagatccta

SEQ ID NO: 52671 - DNA, 15 bp, Homo sapiens
cagggaagatcctag

SEQ ID NO: 52672 - DNA, 15 bp, Homo sapiens
agggaagatcctaga

SEQ ID NO: 52673 - DNA, 15 bp, Homo sapiens
gggaagatcctagag

SEQ ID NO: 52674 - DNA, 15 bp, Homo sapiens
ggaagatcctagagt

SEQ ID NO: 52675 - DNA, 15 bp, Homo sapiens
gaagatcctagagtc

SEQ ID NO: 52676 - DNA, 15 bp, Homo sapiens
aagatcctagagtcg

SEQ ID NO: 52677 - DNA, 15 bp, Homo sapiens
agatcctagagtcgt

SEQ ID NO: 52678 - DNA, 15 bp, Homo sapiens
gatcctagagtcgtt

SEQ ID NO: 52679 - DNA, 15 bp, Homo sapiens
atcctagagtcgttt

SEQ ID NO: 52680 - DNA, 15 bp, Homo sapiens
tcctagagtcgttta

SEQ ID NO: 52681 - DNA, 15 bp, Homo sapiens
cctagagtcgtttaa

SEQ ID NO: 52682 - DNA, 15 bp, Homo sapiens
ctagagtcgtttaaa

SEQ ID NO: 52683 - DNA, 15 bp, Homo sapiens
tagagtcgtttaaaa

SEQ ID NO: 52684 - DNA, 15 bp, Homo sapiens
agagtcgtttaaaac

SEQ ID NO: 52685 - DNA, 15 bp, Homo sapiens
gagtcgtttaaaacc

SEQ ID NO: 52686 - DNA, 15 bp, Homo sapiens
agtcgtttaaaaccc

SEQ ID NO: 52687 - DNA, 15 bp, Homo sapiens
gtcgtttaaaaccca

SEQ ID NO: 52688 - DNA, 15 bp, Homo sapiens
tcgtttaaaacccag

SEQ ID NO: 52689 - DNA, 15 bp, Homo sapiens
cgtttaaaacccaga

SEQ ID NO: 52690 - DNA, 15 bp, Homo sapiens
gtttaaaacccagaa

SEQ ID NO: 52691 - DNA, 15 bp, Homo sapiens
tttaaaacccagaag

SEQ ID NO: 52692 - DNA, 15 bp, Homo sapiens
ttaaaacccagaagg

SEQ ID NO: 52693 - DNA, 15 bp, Homo sapiens
taaaacccagaaggg

SEQ ID NO: 52694 - DNA, 15 bp, Homo sapiens
aaaacccagaagggc

SEQ ID NO: 52695 - DNA, 15 bp, Homo sapiens
aaacccagaagggcc

SEQ ID NO: 52696 - DNA, 15 bp, Homo sapiens
aacccagaagggcct

SEQ ID NO: 52697 - DNA, 15 bp, Homo sapiens
acccagaagggcctt

SEQ ID NO: 52698 - DNA, 15 bp, Homo sapiens
cccagaagggccttc

SEQ ID NO: 52699 - DNA, 15 bp, Homo sapiens
ccagaagggccttcc

SEQ ID NO: 52700 - DNA, 15 bp, Homo sapiens
cagaagggccttcca

SEQ ID NO: 52701 - DNA, 15 bp, Homo sapiens
agaagggccttccag

SEQ ID NO: 52702 - DNA, 15 bp, Homo sapiens
gaagggccttccaga

SEQ ID NO: 52703 - DNA, 15 bp, Homo sapiens
aagggccttccagat

SEQ ID NO: 52704 - DNA, 15 bp, Homo sapiens
agggccttccagatc

SEQ ID NO: 52705 - DNA, 15 bp, Homo sapiens
gggccttccagatca

SEQ ID NO: 52706 - DNA, 15 bp, Homo sapiens
ggccttccagatcag

SEQ ID NO: 52707 - DNA, 15 bp, Homo sapiens
gccttccagatcagt

SEQ ID NO: 52708 - DNA, 15 bp, Homo sapiens
ccttccagatcagtc

SEQ ID NO: 52709 - DNA, 15 bp, Homo sapiens
cttccagatcagtcc

SEQ ID NO: 52710 - DNA, 15 bp, Homo sapiens
ttccagatcagtccc

SEQ ID NO: 52711 - DNA, 15 bp, Homo sapiens
tccagatcagtccca

SEQ ID NO: 52712 - DNA, 15 bp, Homo sapiens
ccagatcagtcccag

SEQ ID NO: 52713 - DNA, 15 bp, Homo sapiens
cagatcagtcccaga

SEQ ID NO: 52714 - DNA, 15 bp, Homo sapiens
agatcagtcccagag

SEQ ID NO: 52715 - DNA, 15 bp, Homo sapiens
gatcagtcccagagg

SEQ ID NO: 52716 - DNA, 15 bp, Homo sapiens
atcagtcccagagga

SEQ ID NO: 52717 - DNA, 15 bp, Homo sapiens
tcagtcccagaggaa

SEQ ID NO: 52718 - DNA, 15 bp, Homo sapiens
cagtcccagaggaac

SEQ ID NO: 52719 - DNA, 15 bp, Homo sapiens
agtcccagaggaaca

SEQ ID NO: 52720 - DNA, 15 bp, Homo sapiens
gtcccagaggaacaa

SEQ ID NO: 52721 - DNA, 15 bp, Homo sapiens
tcccagaggaacaat

SEQ ID NO: 52722 - DNA, 15 bp, Homo sapiens
cccagaggaacaatc

SEQ ID NO: 52723 - DNA, 15 bp, Homo sapiens
ccagaggaacaatct

SEQ ID NO: 52724 - DNA, 15 bp, Homo sapiens
cagaggaacaatctg

SEQ ID NO: 52725 - DNA, 15 bp, Homo sapiens
agaggaacaatctgg

SEQ ID NO: 52726 - DNA, 15 bp, Homo sapiens
gaggaacaatctggt

SEQ ID NO: 52727 - DNA, 15 bp, Homo sapiens
aggaacaatctggtg

SEQ ID NO: 52728 - DNA, 15 bp, Homo sapiens
ggaacaatctggtga

SEQ ID NO: 52729 - DNA, 15 bp, Homo sapiens
gaacaatctggtgat

SEQ ID NO: 52730 - DNA, 15 bp, Homo sapiens
aacaatctggtgatc

SEQ ID NO: 52731 - DNA, 15 bp, Homo sapiens
acaatctggtgatct

SEQ ID NO: 52732 - DNA, 15 bp, Homo sapiens
caatctggtgatcta

SEQ ID NO: 52733 - DNA, 15 bp, Homo sapiens
aatctggtgatctag

SEQ ID NO: 52734 - DNA, 15 bp, Homo sapiens
atctggtgatctagt

SEQ ID NO: 52735 - DNA, 15 bp, Homo sapiens
tctggtgatctagtc

SEQ ID NO: 52736 - DNA, 15 bp, Homo sapiens
ctggtgatctagtct

SEQ ID NO: 52737 - DNA, 15 bp, Homo sapiens
tggtgatctagtctc

SEQ ID NO: 52738 - DNA, 15 bp, Homo sapiens
ggtgatctagtctct

SEQ ID NO: 52739 - DNA, 15 bp, Homo sapiens
gtgatctagtctctt

SEQ ID NO: 52740 - DNA, 15 bp, Homo sapiens
tgatctagtctcttt

SEQ ID NO: 52741 - DNA, 15 bp, Homo sapiens
gatctagtctctttt

SEQ ID NO: 52742 - DNA, 15 bp, Homo sapiens
atctagtctcttttt

SEQ ID NO: 52743 - DNA, 15 bp, Homo sapiens
tctagtctctttttt

SEQ ID NO: 52744 - DNA, 15 bp, Homo sapiens
ctagtctctttttta

SEQ ID NO: 52745 - DNA, 15 bp, Homo sapiens
tagtctcttttttaa

SEQ ID NO: 52746 - DNA, 15 bp, Homo sapiens
agtctcttttttaaa

SEQ ID NO: 52747 - DNA, 15 bp, Homo sapiens
gtctcttttttaaat

SEQ ID NO: 52748 - DNA, 15 bp, Homo sapiens
tctcttttttaaatg

SEQ ID NO: 52749 - DNA, 15 bp, Homo sapiens
ctcttttttaaatga

SEQ ID NO: 52750 - DNA, 15 bp, Homo sapiens
tcttttttaaatgag

SEQ ID NO: 52751 - DNA, 15 bp, Homo sapiens
cttttttaaatgaga

SEQ ID NO: 52752 - DNA, 15 bp, Homo sapiens
ttttttaaatgagac

SEQ ID NO: 52753 - DNA, 15 bp, Homo sapiens
tttttaaatgagacg

SEQ ID NO: 52754 - DNA, 15 bp, Homo sapiens
ttttaaatgagacgt

SEQ ID NO: 52755 - DNA, 15 bp, Homo sapiens
tttaaatgagacgtg

SEQ ID NO: 52756 - DNA, 15 bp, Homo sapiens
ttaaatgagacgtgt

SEQ ID NO: 52757 - DNA, 15 bp, Homo sapiens
taaatgagacgtgtt

SEQ ID NO: 52758 - DNA, 15 bp, Homo sapiens
aaatgagacgtgttt

SEQ ID NO: 52759 - DNA, 15 bp, Homo sapiens
aatgagacgtgtttt

SEQ ID NO: 52760 - DNA, 15 bp, Homo sapiens
atgagacgtgttttt

SEQ ID NO: 52761 - DNA, 15 bp, Homo sapiens
tgagacgtgttttta

SEQ ID NO: 52762 - DNA, 15 bp, Homo sapiens
gagacgtgtttttat

SEQ ID NO: 52763 - DNA, 15 bp, Homo sapiens
agacgtgtttttatt

SEQ ID NO: 52764 - DNA, 15 bp, Homo sapiens
gacgtgtttttattg

SEQ ID NO: 52765 - DNA, 15 bp, Homo sapiens
acgtgtttttattgt

SEQ ID NO: 52766 - DNA, 15 bp, Homo sapiens
cgtgtttttattgta

SEQ ID NO: 52767 - DNA, 15 bp, Homo sapiens
gtgtttttattgtaa

SEQ ID NO: 52768 - DNA, 15 bp, Homo sapiens
tgtttttattgtaag

SEQ ID NO: 52769 - DNA, 15 bp, Homo sapiens
gtttttattgtaagt

SEQ ID NO: 52770 - DNA, 15 bp, Homo sapiens
tttttattgtaagtt

SEQ ID NO: 52771 - DNA, 15 bp, Homo sapiens
ttttattgtaagttt

SEQ ID NO: 52772 - DNA, 15 bp, Homo sapiens
tttattgtaagtttt

SEQ ID NO: 52773 - DNA, 15 bp, Homo sapiens
ttattgtaagttttc

SEQ ID NO: 52774 - DNA, 15 bp, Homo sapiens
tattgtaagttttct

SEQ ID NO: 52775 - DNA, 15 bp, Homo sapiens
attgtaagttttctg

SEQ ID NO: 52776 - DNA, 15 bp, Homo sapiens
ttgtaagttttctga

SEQ ID NO: 52777 - DNA, 15 bp, Homo sapiens
tgtaagttttctgaa

SEQ ID NO: 52778 - DNA, 15 bp, Homo sapiens
gtaagttttctgaaa

SEQ ID NO: 52779 - DNA, 15 bp, Homo sapiens
taagttttctgaaaa

SEQ ID NO: 52780 - DNA, 15 bp, Homo sapiens
aagttttctgaaaat

SEQ ID NO: 52781 - DNA, 15 bp, Homo sapiens
agttttctgaaaatt

SEQ ID NO: 52782 - DNA, 15 bp, Homo sapiens
gttttctgaaaattg

SEQ ID NO: 52783 - DNA, 15 bp, Homo sapiens
ttttctgaaaattga

SEQ ID NO: 52784 - DNA, 15 bp, Homo sapiens
tttctgaaaattgag

SEQ ID NO: 52785 - DNA, 15 bp, Homo sapiens
ttctgaaaattgagg

SEQ ID NO: 52786 - DNA, 15 bp, Homo sapiens
tctgaaaattgagga

SEQ ID NO: 52787 - DNA, 15 bp, Homo sapiens
ctgaaaattgaggat

SEQ ID NO: 52788 - DNA, 15 bp, Homo sapiens
tgaaaattgaggatg

SEQ ID NO: 52789 - DNA, 15 bp, Homo sapiens
gaaaattgaggatgt

SEQ ID NO: 52790 - DNA, 15 bp, Homo sapiens
aaaattgaggatgta

SEQ ID NO: 52791 - DNA, 15 bp, Homo sapiens
aaattgaggatgtaa

SEQ ID NO: 52792 - DNA, 15 bp, Homo sapiens
aattgaggatgtaat

SEQ ID NO: 52793 - DNA, 15 bp, Homo sapiens
attgaggatgtaatc

SEQ ID NO: 52794 - DNA, 15 bp, Homo sapiens
ttgaggatgtaatca

SEQ ID NO: 52795 - DNA, 15 bp, Homo sapiens
tgaggatgtaatcag

SEQ ID NO: 52796 - DNA, 15 bp, Homo sapiens
gaggatgtaatcagt

SEQ ID NO: 52797 - DNA, 15 bp, Homo sapiens
aggatgtaatcagtc

SEQ ID NO: 52798 - DNA, 15 bp, Homo sapiens
ggatgtaatcagtca

SEQ ID NO: 52799 - DNA, 15 bp, Homo sapiens
gatgtaatcagtcag

SEQ ID NO: 52800 - DNA, 15 bp, Homo sapiens
atgtaatcagtcagt

SEQ ID NO: 52801 - DNA, 15 bp, Homo sapiens
tgtaatcagtcagtt

SEQ ID NO: 52802 - DNA, 15 bp, Homo sapiens
gtaatcagtcagttg

SEQ ID NO: 52803 - DNA, 15 bp, Homo sapiens
taatcagtcagttgt

SEQ ID NO: 52804 - DNA, 15 bp, Homo sapiens
aatcagtcagttgtt

SEQ ID NO: 52805 - DNA, 15 bp, Homo sapiens
atcagtcagttgttt

SEQ ID NO: 52806 - DNA, 15 bp, Homo sapiens
tcagtcagttgtttg

SEQ ID NO: 52807 - DNA, 15 bp, Homo sapiens
cagtcagttgtttgg

SEQ ID NO: 52808 - DNA, 15 bp, Homo sapiens
agtcagttgtttgga

SEQ ID NO: 52809 - DNA, 15 bp, Homo sapiens
gtcagttgtttggat

SEQ ID NO: 52810 - DNA, 15 bp, Homo sapiens
tcagttgtttggatc

SEQ ID NO: 52811 - DNA, 15 bp, Homo sapiens
cagttgtttggatca

SEQ ID NO: 52812 - DNA, 15 bp, Homo sapiens
agttgtttggatcac

SEQ ID NO: 52813 - DNA, 15 bp, Homo sapiens
gttgtttggatcacc

SEQ ID NO: 52814 - DNA, 15 bp, Homo sapiens
ttgtttggatcaccc

SEQ ID NO: 52815 - DNA, 15 bp, Homo sapiens
tgtttggatcaccct

SEQ ID NO: 52816 - DNA, 15 bp, Homo sapiens
gtttggatcaccctg

SEQ ID NO: 52817 - DNA, 15 bp, Homo sapiens
tttggatcaccctgc

SEQ ID NO: 52818 - DNA, 15 bp, Homo sapiens
ttggatcaccctgct

SEQ ID NO: 52819 - DNA, 15 bp, Homo sapiens
tggatcaccctgctt

SEQ ID NO: 52820 - DNA, 15 bp, Homo sapiens
ggatcaccctgcttt

SEQ ID NO: 52821 - DNA, 15 bp, Homo sapiens
gatcaccctgctttt

SEQ ID NO: 52822 - DNA, 15 bp, Homo sapiens
atcaccctgctttta

SEQ ID NO: 52823 - DNA, 15 bp, Homo sapiens
tcaccctgcttttaa

SEQ ID NO: 52824 - DNA, 15 bp, Homo sapiens
caccctgcttttaag

SEQ ID NO: 52825 - DNA, 15 bp, Homo sapiens
accctgcttttaagt

SEQ ID NO: 52826 - DNA, 15 bp, Homo sapiens
ccctgcttttaagtt

SEQ ID NO: 52827 - DNA, 15 bp, Homo sapiens
cctgcttttaagttc

SEQ ID NO: 52828 - DNA, 15 bp, Homo sapiens
ctgcttttaagttct

SEQ ID NO: 52829 - DNA, 15 bp, Homo sapiens
tgcttttaagttctt

SEQ ID NO: 52830 - DNA, 15 bp, Homo sapiens
gcttttaagttcttt

SEQ ID NO: 52831 - DNA, 15 bp, Homo sapiens
cttttaagttcttta

SEQ ID NO: 52832 - DNA, 15 bp, Homo sapiens
ttttaagttctttaa

SEQ ID NO: 52833 - DNA, 15 bp, Homo sapiens
tttaagttctttaag

SEQ ID NO: 52834 - DNA, 15 bp, Homo sapiens
ttaagttctttaaga

SEQ ID NO: 52835 - DNA, 15 bp, Homo sapiens
taagttctttaagag

SEQ ID NO: 52836 - DNA, 15 bp, Homo sapiens
aagttctttaagagc

SEQ ID NO: 52837 - DNA, 15 bp, Homo sapiens
agttctttaagagct

SEQ ID NO: 52838 - DNA, 15 bp, Homo sapiens
gttctttaagagctg

SEQ ID NO: 52839 - DNA, 15 bp, Homo sapiens
ttctttaagagctgg

SEQ ID NO: 52840 - DNA, 15 bp, Homo sapiens
tctttaagagctggc

SEQ ID NO: 52841 - DNA, 15 bp, Homo sapiens
ctttaagagctggct

SEQ ID NO: 52842 - DNA, 15 bp, Homo sapiens
tttaagagctggcta

SEQ ID NO: 52843 - DNA, 15 bp, Homo sapiens
ttaagagctggctat

SEQ ID NO: 52844 - DNA, 15 bp, Homo sapiens
taagagctggctatt

SEQ ID NO: 52845 - DNA, 15 bp, Homo sapiens
aagagctggctattg

SEQ ID NO: 52846 - DNA, 15 bp, Homo sapiens
agagctggctattga

SEQ ID NO: 52847 - DNA, 15 bp, Homo sapiens
gagctggctattgat

SEQ ID NO: 52848 - DNA, 15 bp, Homo sapiens
agctggctattgatg

SEQ ID NO: 52849 - DNA, 15 bp, Homo sapiens
gctggctattgatga

SEQ ID NO: 52850 - DNA, 15 bp, Homo sapiens
ctggctattgatgaa

SEQ ID NO: 52851 - DNA, 15 bp, Homo sapiens
tggctattgatgaag

SEQ ID NO: 52852 - DNA, 15 bp, Homo sapiens
ggctattgatgaagc

SEQ ID NO: 52853 - DNA, 15 bp, Homo sapiens
gctattgatgaagca

SEQ ID NO: 52854 - DNA, 15 bp, Homo sapiens
ctattgatgaagcat

SEQ ID NO: 52855 - DNA, 15 bp, Homo sapiens
tattgatgaagcatt

SEQ ID NO: 52856 - DNA, 15 bp, Homo sapiens
attgatgaagcattt

SEQ ID NO: 52857 - DNA, 15 bp, Homo sapiens
ttgatgaagcatttc

SEQ ID NO: 52858 - DNA, 15 bp, Homo sapiens
tgatgaagcatttcc

SEQ ID NO: 52859 - DNA, 15 bp, Homo sapiens
gatgaagcatttcca

SEQ ID NO: 52860 - DNA, 15 bp, Homo sapiens
atgaagcatttccag

SEQ ID NO: 52861 - DNA, 15 bp, Homo sapiens
tgaagcatttccagt

SEQ ID NO: 52862 - DNA, 15 bp, Homo sapiens
gaagcatttccagta

SEQ ID NO: 52863 - DNA, 15 bp, Homo sapiens
aagcatttccagtat

SEQ ID NO: 52864 - DNA, 15 bp, Homo sapiens
agcatttccagtatt

SEQ ID NO: 52865 - DNA, 15 bp, Homo sapiens
gcatttccagtattc

SEQ ID NO: 52866 - DNA, 15 bp, Homo sapiens
catttccagtattct

SEQ ID NO: 52867 - DNA, 15 bp, Homo sapiens
atttccagtattctt

SEQ ID NO: 52868 - DNA, 15 bp, Homo sapiens
tttccagtattcttc

SEQ ID NO: 52869 - DNA, 15 bp, Homo sapiens
ttccagtattcttcc

SEQ ID NO: 52870 - DNA, 15 bp, Homo sapiens
tccagtattcttccc

SEQ ID NO: 52871 - DNA, 15 bp, Homo sapiens
ccagtattcttcccc

SEQ ID NO: 52872 - DNA, 15 bp, Homo sapiens
cagtattcttcccct

SEQ ID NO: 52873 - DNA, 15 bp, Homo sapiens
agtattcttcccctc

SEQ ID NO: 52874 - DNA, 15 bp, Homo sapiens
gtattcttcccctca

SEQ ID NO: 52875 - DNA, 15 bp, Homo sapiens
tattcttcccctcac

SEQ ID NO: 52876 - DNA, 15 bp, Homo sapiens
attcttcccctcacc

SEQ ID NO: 52877 - DNA, 15 bp, Homo sapiens
ttcttcccctcacct

SEQ ID NO: 52878 - DNA, 15 bp, Homo sapiens
tcttcccctcacctg

SEQ ID NO: 52879 - DNA, 15 bp, Homo sapiens
cttcccctcacctga

SEQ ID NO: 52880 - DNA, 15 bp, Homo sapiens
ttcccctcacctgat

SEQ ID NO: 52881 - DNA, 15 bp, Homo sapiens
tcccctcacctgatt

SEQ ID NO: 52882 - DNA, 15 bp, Homo sapiens
cccctcacctgattt

SEQ ID NO: 52883 - DNA, 15 bp, Homo sapiens
ccctcacctgatttt

SEQ ID NO: 52884 - DNA, 15 bp, Homo sapiens
cctcacctgattttc

SEQ ID NO: 52885 - DNA, 15 bp, Homo sapiens
ctcacctgattttca

SEQ ID NO: 52886 - DNA, 15 bp, Homo sapiens
tcacctgattttcac

SEQ ID NO: 52887 - DNA, 15 bp, Homo sapiens
cacctgattttcacc

SEQ ID NO: 52888 - DNA, 15 bp, Homo sapiens
acctgattttcaccc

SEQ ID NO: 52889 - DNA, 15 bp, Homo sapiens
cctgattttcaccca

SEQ ID NO: 52890 - DNA, 15 bp, Homo sapiens
ctgattttcacccag

SEQ ID NO: 52891 - DNA, 15 bp, Homo sapiens
tgattttcacccaga

SEQ ID NO: 52892 - DNA, 15 bp, Homo sapiens
gattttcacccagat

SEQ ID NO: 52893 - DNA, 15 bp, Homo sapiens
attttcacccagata

SEQ ID NO: 52894 - DNA, 15 bp, Homo sapiens
ttttcacccagatac

SEQ ID NO: 52895 - DNA, 15 bp, Homo sapiens
tttcacccagataca

SEQ ID NO: 52896 - DNA, 15 bp, Homo sapiens
ttcacccagatacat

SEQ ID NO: 52897 - DNA, 15 bp, Homo sapiens
tcacccagatacatt

SEQ ID NO: 52898 - DNA, 15 bp, Homo sapiens
cacccagatacatta

SEQ ID NO: 52899 - DNA, 15 bp, Homo sapiens
acccagatacattat

SEQ ID NO: 52900 - DNA, 15 bp, Homo sapiens
cccagatacattatg

SEQ ID NO: 52901 - DNA, 15 bp, Homo sapiens
ccagatacattatgt

SEQ ID NO: 52902 - DNA, 15 bp, Homo sapiens
cagatacattatgtt

SEQ ID NO: 52903 - DNA, 15 bp, Homo sapiens
agatacattatgtta

SEQ ID NO: 52904 - DNA, 15 bp, Homo sapiens
gatacattatgttaa

SEQ ID NO: 52905 - DNA, 15 bp, Homo sapiens
atacattatgttaaa

SEQ ID NO: 52906 - DNA, 15 bp, Homo sapiens
tacattatgttaaat

SEQ ID NO: 52907 - DNA, 15 bp, Homo sapiens
acattatgttaaatt

SEQ ID NO: 52908 - DNA, 15 bp, Homo sapiens
cattatgttaaattt

SEQ ID NO: 52909 - DNA, 15 bp, Homo sapiens
attatgttaaattta

SEQ ID NO: 52910 - DNA, 15 bp, Homo sapiens
ttatgttaaatttac

SEQ ID NO: 52911 - DNA, 15 bp, Homo sapiens
tatgttaaatttact

SEQ ID NO: 52912 - DNA, 15 bp, Homo sapiens
atgttaaatttactt

SEQ ID NO: 52913 - DNA, 15 bp, Homo sapiens
tgttaaatttacttt

SEQ ID NO: 52914 - DNA, 15 bp, Homo sapiens
gttaaatttactttc

SEQ ID NO: 52915 - DNA, 15 bp, Homo sapiens
ttaaatttactttct

SEQ ID NO: 52916 - DNA, 15 bp, Homo sapiens
taaatttactttctt

SEQ ID NO: 52917 - DNA, 15 bp, Homo sapiens
aaatttactttcttc

SEQ ID NO: 52918 - DNA, 15 bp, Homo sapiens
aatttactttcttct

SEQ ID NO: 52919 - DNA, 15 bp, Homo sapiens
atttactttcttctc

SEQ ID NO: 52920 - DNA, 15 bp, Homo sapiens
tttactttcttctct

SEQ ID NO: 52921 - DNA, 15 bp, Homo sapiens
ttactttcttctctt

SEQ ID NO: 52922 - DNA, 15 bp, Homo sapiens
tactttcttctcttt

SEQ ID NO: 52923 - DNA, 15 bp, Homo sapiens
actttcttctctttt

SEQ ID NO: 52924 - DNA, 15 bp, Homo sapiens
ctttcttctctttta

SEQ ID NO: 52925 - DNA, 15 bp, Homo sapiens
tttcttctcttttaa

SEQ ID NO: 52926 - DNA, 15 bp, Homo sapiens
ttcttctcttttaaa

SEQ ID NO: 52927 - DNA, 15 bp, Homo sapiens
tcttctcttttaaaa

SEQ ID NO: 52928 - DNA, 15 bp, Homo sapiens
cttctcttttaaaaa

SEQ ID NO: 52929 - DNA, 15 bp, Homo sapiens
ttctcttttaaaaaa

SEQ ID NO: 52930 - DNA, 15 bp, Homo sapiens
tctcttttaaaaaaa

SEQ ID NO: 52931 - DNA, 15 bp, Homo sapiens
ctcttttaaaaaaaa

SEQ ID NO: 52932 - DNA, 15 bp, Homo sapiens
tcttttaaaaaaaaa

SEQ ID NO: 52933 - DNA, 15 bp, Homo sapiens
cttttaaaaaaaaat

SEQ ID NO: 52934 - DNA, 15 bp, Homo sapiens
ttttaaaaaaaaatc

SEQ ID NO: 52935 - DNA, 15 bp, Homo sapiens
tttaaaaaaaaatct

SEQ ID NO: 52936 - DNA, 15 bp, Homo sapiens
ttaaaaaaaaatctt

SEQ ID NO: 52937 - DNA, 15 bp, Homo sapiens
taaaaaaaaatctta

SEQ ID NO: 52938 - DNA, 15 bp, Homo sapiens
aaaaaaaaatcttag

SEQ ID NO: 52939 - DNA, 15 bp, Homo sapiens
aaaaaaaatcttagt

SEQ ID NO: 52940 - DNA, 15 bp, Homo sapiens
aaaaaaatcttagtt

SEQ ID NO: 52941 - DNA, 15 bp, Homo sapiens
aaaaaatcttagttt

SEQ ID NO: 52942 - DNA, 15 bp, Homo sapiens
aaaaatcttagtttt

SEQ ID NO: 52943 - DNA, 15 bp, Homo sapiens
aaaatcttagttttg

SEQ ID NO: 52944 - DNA, 15 bp, Homo sapiens
aaatcttagttttga

SEQ ID NO: 52945 - DNA, 15 bp, Homo sapiens
aatcttagttttgaa

SEQ ID NO: 52946 - DNA, 15 bp, Homo sapiens
atcttagttttgaaa

SEQ ID NO: 52947 - DNA, 15 bp, Homo sapiens
tcttagttttgaaac

SEQ ID NO: 52948 - DNA, 15 bp, Homo sapiens
cttagttttgaaaca

SEQ ID NO: 52949 - DNA, 15 bp, Homo sapiens
ttagttttgaaacat

SEQ ID NO: 52950 - DNA, 15 bp, Homo sapiens
tagttttgaaacata

SEQ ID NO: 52951 - DNA, 15 bp, Homo sapiens
agttttgaaacatac

SEQ ID NO: 52952 - DNA, 15 bp, Homo sapiens
gttttgaaacatact

SEQ ID NO: 52953 - DNA, 15 bp, Homo sapiens
ttttgaaacatacta

SEQ ID NO: 52954 - DNA, 15 bp, Homo sapiens
tttgaaacatactat

SEQ ID NO: 52955 - DNA, 15 bp, Homo sapiens
ttgaaacatactata

SEQ ID NO: 52956 - DNA, 15 bp, Homo sapiens
tgaaacatactataa

SEQ ID NO: 52957 - DNA, 15 bp, Homo sapiens
gaaacatactataag

SEQ ID NO: 52958 - DNA, 15 bp, Homo sapiens
aaacatactataagt

SEQ ID NO: 52959 - DNA, 15 bp, Homo sapiens
aacatactataagtg

SEQ ID NO: 52960 - DNA, 15 bp, Homo sapiens
acatactataagtgt

SEQ ID NO: 52961 - DNA, 15 bp, Homo sapiens
catactataagtgta

SEQ ID NO: 52962 - DNA, 15 bp, Homo sapiens
atactataagtgtac

SEQ ID NO: 52963 - DNA, 15 bp, Homo sapiens
tactataagtgtact

SEQ ID NO: 52964 - DNA, 15 bp, Homo sapiens
actataagtgtactc

SEQ ID NO: 52965 - DNA, 15 bp, Homo sapiens
ctataagtgtactct

SEQ ID NO: 52966 - DNA, 15 bp, Homo sapiens
tataagtgtactctc

SEQ ID NO: 52967 - DNA, 15 bp, Homo sapiens
ataagtgtactctcc

SEQ ID NO: 52968 - DNA, 15 bp, Homo sapiens
taagtgtactctcct

SEQ ID NO: 52969 - DNA, 15 bp, Homo sapiens
aagtgtactctcctc

SEQ ID NO: 52970 - DNA, 15 bp, Homo sapiens
agtgtactctcctct

SEQ ID NO: 52971 - DNA, 15 bp, Homo sapiens
gtgtactctcctctc

SEQ ID NO: 52972 - DNA, 15 bp, Homo sapiens
tgtactctcctctcc

SEQ ID NO: 52973 - DNA, 15 bp, Homo sapiens
gtactctcctctccc

SEQ ID NO: 52974 - DNA, 15 bp, Homo sapiens
tactctcctctcccc

SEQ ID NO: 52975 - DNA, 15 bp, Homo sapiens
actctcctctccccc

SEQ ID NO: 52976 - DNA, 15 bp, Homo sapiens
ctctcctctccccca

SEQ ID NO: 52977 - DNA, 15 bp, Homo sapiens
tctcctctcccccag

SEQ ID NO: 52978 - DNA, 15 bp, Homo sapiens
ctcctctcccccaga

SEQ ID NO: 52979 - DNA, 15 bp, Homo sapiens
tcctctcccccagag

SEQ ID NO: 52980 - DNA, 15 bp, Homo sapiens
cctctcccccagagg

SEQ ID NO: 52981 - DNA, 15 bp, Homo sapiens
ctctcccccagaggt

SEQ ID NO: 52982 - DNA, 15 bp, Homo sapiens
tctcccccagaggta

SEQ ID NO: 52983 - DNA, 15 bp, Homo sapiens
ctcccccagaggtaa

SEQ ID NO: 52984 - DNA, 15 bp, Homo sapiens
tcccccagaggtaac

SEQ ID NO: 52985 - DNA, 15 bp, Homo sapiens
cccccagaggtaact

SEQ ID NO: 52986 - DNA, 15 bp, Homo sapiens
ccccagaggtaactg

SEQ ID NO: 52987 - DNA, 15 bp, Homo sapiens
cccagaggtaactga

SEQ ID NO: 52988 - DNA, 15 bp, Homo sapiens
ccagaggtaactgaa

SEQ ID NO: 52989 - DNA, 15 bp, Homo sapiens
cagaggtaactgaag

SEQ ID NO: 52990 - DNA, 15 bp, Homo sapiens
agaggtaactgaagt

SEQ ID NO: 52991 - DNA, 15 bp, Homo sapiens
gaggtaactgaagtt

SEQ ID NO: 52992 - DNA, 15 bp, Homo sapiens
aggtaactgaagttg

SEQ ID NO: 52993 - DNA, 15 bp, Homo sapiens
ggtaactgaagttgg

SEQ ID NO: 52994 - DNA, 15 bp, Homo sapiens
gtaactgaagttgga

SEQ ID NO: 52995 - DNA, 15 bp, Homo sapiens
taactgaagttggaa

SEQ ID NO: 52996 - DNA, 15 bp, Homo sapiens
aactgaagttggaat

SEQ ID NO: 52997 - DNA, 15 bp, Homo sapiens
actgaagttggaatt

SEQ ID NO: 52998 - DNA, 15 bp, Homo sapiens
ctgaagttggaattt

SEQ ID NO: 52999 - DNA, 15 bp, Homo sapiens
tgaagttggaattta

SEQ ID NO: 53000 - DNA, 15 bp, Homo sapiens
gaagttggaatttag

SEQ ID NO: 53001 - DNA, 15 bp, Homo sapiens
aagttggaatttagc

SEQ ID NO: 53002 - DNA, 15 bp, Homo sapiens
agttggaatttagca

SEQ ID NO: 53003 - DNA, 15 bp, Homo sapiens
gttggaatttagcaa

SEQ ID NO: 53004 - DNA, 15 bp, Homo sapiens
ttggaatttagcaaa

SEQ ID NO: 53005 - DNA, 15 bp, Homo sapiens
tggaatttagcaaaa

SEQ ID NO: 53006 - DNA, 15 bp, Homo sapiens
ggaatttagcaaaaa

SEQ ID NO: 53007 - DNA, 15 bp, Homo sapiens
gaatttagcaaaaat

SEQ ID NO: 53008 - DNA, 15 bp, Homo sapiens
aatttagcaaaaata

SEQ ID NO: 53009 - DNA, 15 bp, Homo sapiens
atttagcaaaaatat

SEQ ID NO: 53010 - DNA, 15 bp, Homo sapiens
tttagcaaaaatatt

SEQ ID NO: 53011 - DNA, 15 bp, Homo sapiens
ttagcaaaaatatta

SEQ ID NO: 53012 - DNA, 15 bp, Homo sapiens
tagcaaaaatattaa

SEQ ID NO: 53013 - DNA, 15 bp, Homo sapiens
agcaaaaatattaaa

SEQ ID NO: 53014 - DNA, 15 bp, Homo sapiens
gcaaaaatattaaaa

SEQ ID NO: 53015 - DNA, 15 bp, Homo sapiens
caaaaatattaaaaa

SEQ ID NO: 53016 - DNA, 15 bp, Homo sapiens
aaaaatattaaaaac

SEQ ID NO: 53017 - DNA, 15 bp, Homo sapiens
aaaatattaaaaaca

SEQ ID NO: 53018 - DNA, 15 bp, Homo sapiens
aaatattaaaaacat

SEQ ID NO: 53019 - DNA, 15 bp, Homo sapiens
aatattaaaaacatg

SEQ ID NO: 53020 - DNA, 15 bp, Homo sapiens
atattaaaaacatgg

SEQ ID NO: 53021 - DNA, 15 bp, Homo sapiens
tattaaaaacatggg

SEQ ID NO: 53022 - DNA, 15 bp, Homo sapiens
attaaaaacatggga

SEQ ID NO: 53023 - DNA, 15 bp, Homo sapiens
ttaaaaacatgggag

SEQ ID NO: 53024 - DNA, 15 bp, Homo sapiens
taaaaacatgggagt

SEQ ID NO: 53025 - DNA, 15 bp, Homo sapiens
aaaaacatgggagtg

SEQ ID NO: 53026 - DNA, 15 bp, Homo sapiens
aaaacatgggagtgc

SEQ ID NO: 53027 - DNA, 15 bp, Homo sapiens
aaacatgggagtgct

SEQ ID NO: 53028 - DNA, 15 bp, Homo sapiens
aacatgggagtgctg

SEQ ID NO: 53029 - DNA, 15 bp, Homo sapiens
acatgggagtgctgt

SEQ ID NO: 53030 - DNA, 15 bp, Homo sapiens
catgggagtgctgtt

SEQ ID NO: 53031 - DNA, 15 bp, Homo sapiens
atgggagtgctgttt

SEQ ID NO: 53032 - DNA, 15 bp, Homo sapiens
tgggagtgctgtttt

SEQ ID NO: 53033 - DNA, 15 bp, Homo sapiens
gggagtgctgttttt

SEQ ID NO: 53034 - DNA, 15 bp, Homo sapiens
ggagtgctgtttttg

SEQ ID NO: 53035 - DNA, 15 bp, Homo sapiens
gagtgctgtttttgt

SEQ ID NO: 53036 - DNA, 15 bp, Homo sapiens
agtgctgtttttgtg

SEQ ID NO: 53037 - DNA, 15 bp, Homo sapiens
gtgctgtttttgtgt

SEQ ID NO: 53038 - DNA, 15 bp, Homo sapiens
tgctgtttttgtgtc

SEQ ID NO: 53039 - DNA, 15 bp, Homo sapiens
gctgtttttgtgtct

SEQ ID NO: 53040 - DNA, 15 bp, Homo sapiens
ctgtttttgtgtctg

SEQ ID NO: 53041 - DNA, 15 bp, Homo sapiens
tgtttttgtgtctgt

SEQ ID NO: 53042 - DNA, 15 bp, Homo sapiens
gtttttgtgtctgta

SEQ ID NO: 53043 - DNA, 15 bp, Homo sapiens
tttttgtgtctgtag

SEQ ID NO: 53044 - DNA, 15 bp, Homo sapiens
ttttgtgtctgtaga

SEQ ID NO: 53045 - DNA, 15 bp, Homo sapiens
tttgtgtctgtagac

SEQ ID NO: 53046 - DNA, 15 bp, Homo sapiens
ttgtgtctgtagaca

SEQ ID NO: 53047 - DNA, 15 bp, Homo sapiens
tgtgtctgtagacag

SEQ ID NO: 53048 - DNA, 15 bp, Homo sapiens
gtgtctgtagacagt

SEQ ID NO: 53049 - DNA, 15 bp, Homo sapiens
tgtctgtagacagta

SEQ ID NO: 53050 - DNA, 15 bp, Homo sapiens
gtctgtagacagtat

SEQ ID NO: 53051 - DNA, 15 bp, Homo sapiens
tctgtagacagtatt

SEQ ID NO: 53052 - DNA, 15 bp, Homo sapiens
ctgtagacagtatta

SEQ ID NO: 53053 - DNA, 15 bp, Homo sapiens
tgtagacagtattat

SEQ ID NO: 53054 - DNA, 15 bp, Homo sapiens
gtagacagtattatt

SEQ ID NO: 53055 - DNA, 15 bp, Homo sapiens
tagacagtattattt

SEQ ID NO: 53056 - DNA, 15 bp, Homo sapiens
agacagtattatttt

SEQ ID NO: 53057 - DNA, 15 bp, Homo sapiens
gacagtattattttt

SEQ ID NO: 53058 - DNA, 15 bp, Homo sapiens
acagtattatttttg

SEQ ID NO: 53059 - DNA, 15 bp, Homo sapiens
cagtattatttttgc

SEQ ID NO: 53060 - DNA, 15 bp, Homo sapiens
agtattatttttgca

SEQ ID NO: 53061 - DNA, 15 bp, Homo sapiens
gtattatttttgcat

SEQ ID NO: 53062 - DNA, 15 bp, Homo sapiens
tattatttttgcatg

SEQ ID NO: 53063 - DNA, 15 bp, Homo sapiens
attatttttgcatgc

SEQ ID NO: 53064 - DNA, 15 bp, Homo sapiens
ttatttttgcatgct

SEQ ID NO: 53065 - DNA, 15 bp, Homo sapiens
tatttttgcatgctt

SEQ ID NO: 53066 - DNA, 15 bp, Homo sapiens
atttttgcatgcttt

SEQ ID NO: 53067 - DNA, 15 bp, Homo sapiens
tttttgcatgctttt

SEQ ID NO: 53068 - DNA, 15 bp, Homo sapiens
ttttgcatgcttttg

SEQ ID NO: 53069 - DNA, 15 bp, Homo sapiens
tttgcatgcttttga

SEQ ID NO: 53070 - DNA, 15 bp, Homo sapiens
ttgcatgcttttgaa

SEQ ID NO: 53071 - DNA, 15 bp, Homo sapiens
tgcatgcttttgaag

SEQ ID NO: 53072 - DNA, 15 bp, Homo sapiens
gcatgcttttgaagg

SEQ ID NO: 53073 - DNA, 15 bp, Homo sapiens
catgcttttgaaggc

SEQ ID NO: 53074 - DNA, 15 bp, Homo sapiens
atgcttttgaaggca

SEQ ID NO: 53075 - DNA, 15 bp, Homo sapiens
tgcttttgaaggcat

SEQ ID NO: 53076 - DNA, 15 bp, Homo sapiens
gcttttgaaggcata

SEQ ID NO: 53077 - DNA, 15 bp, Homo sapiens
cttttgaaggcatat

SEQ ID NO: 53078 - DNA, 15 bp, Homo sapiens
ttttgaaggcatatt

SEQ ID NO: 53079 - DNA, 15 bp, Homo sapiens
tttgaaggcatattt

SEQ ID NO: 53080 - DNA, 15 bp, Homo sapiens
ttgaaggcatatttt

SEQ ID NO: 53081 - DNA, 15 bp, Homo sapiens
tgaaggcatattttt

SEQ ID NO: 53082 - DNA, 15 bp, Homo sapiens
gaaggcatatttttt

SEQ ID NO: 53083 - DNA, 15 bp, Homo sapiens
aaggcatattttttg

SEQ ID NO: 53084 - DNA, 15 bp, Homo sapiens
aggcatattttttgg

SEQ ID NO: 53085 - DNA, 15 bp, Homo sapiens
ggcatattttttggc

SEQ ID NO: 53086 - DNA, 15 bp, Homo sapiens
gcatattttttggcc

SEQ ID NO: 53087 - DNA, 15 bp, Homo sapiens
catattttttggccg

SEQ ID NO: 53088 - DNA, 15 bp, Homo sapiens
atattttttggccga

SEQ ID NO: 53089 - DNA, 15 bp, Homo sapiens
tattttttggccgag

SEQ ID NO: 53090 - DNA, 15 bp, Homo sapiens
attttttggccgagt

SEQ ID NO: 53091 - DNA, 15 bp, Homo sapiens
ttttttggccgagtg

SEQ ID NO: 53092 - DNA, 15 bp, Homo sapiens
tttttggccgagtgc

SEQ ID NO: 53093 - DNA, 15 bp, Homo sapiens
ttttggccgagtgca

SEQ ID NO: 53094 - DNA, 15 bp, Homo sapiens
tttggccgagtgcag

SEQ ID NO: 53095 - DNA, 15 bp, Homo sapiens
ttggccgagtgcagt

SEQ ID NO: 53096 - DNA, 15 bp, Homo sapiens
tggccgagtgcagtg

SEQ ID NO: 53097 - DNA, 15 bp, Homo sapiens
ggccgagtgcagtgg

SEQ ID NO: 53098 - DNA, 15 bp, Homo sapiens
gccgagtgcagtggc

SEQ ID NO: 53099 - DNA, 15 bp, Homo sapiens
ccgagtgcagtggct

SEQ ID NO: 53100 - DNA, 15 bp, Homo sapiens
cgagtgcagtggctc

SEQ ID NO: 53101 - DNA, 15 bp, Homo sapiens
gagtgcagtggctca

SEQ ID NO: 53102 - DNA, 15 bp, Homo sapiens
agtgcagtggctcat

SEQ ID NO: 53103 - DNA, 15 bp, Homo sapiens
gtgcagtggctcatg

SEQ ID NO: 53104 - DNA, 15 bp, Homo sapiens
tgcagtggctcatgc

SEQ ID NO: 53105 - DNA, 15 bp, Homo sapiens
gctcatgcctgtaac

SEQ ID NO: 53106 - DNA, 15 bp, Homo sapiens
ctcatgcctgtaacc

SEQ ID NO: 53107 - DNA, 15 bp, Homo sapiens
tcatgcctgtaaccc

SEQ ID NO: 53108 - DNA, 15 bp, Homo sapiens
catgcctgtaacccc

SEQ ID NO: 53109 - DNA, 15 bp, Homo sapiens
atgcctgtaacccca

SEQ ID NO: 53110 - DNA, 15 bp, Homo sapiens
tgcctgtaaccccaa

SEQ ID NO: 53111 - DNA, 15 bp, Homo sapiens
gcctgtaaccccaac

SEQ ID NO: 53112 - DNA, 15 bp, Homo sapiens
cctgtaaccccaaca

SEQ ID NO: 53113 - DNA, 15 bp, Homo sapiens
ctgtaaccccaacac

SEQ ID NO: 53114 - DNA, 15 bp, Homo sapiens
tgtaaccccaacact

SEQ ID NO: 53115 - DNA, 15 bp, Homo sapiens
gtaaccccaacactt

SEQ ID NO: 53116 - DNA, 15 bp, Homo sapiens
taaccccaacacttg

SEQ ID NO: 53117 - DNA, 15 bp, Homo sapiens
aaccccaacacttgg

SEQ ID NO: 53118 - DNA, 15 bp, Homo sapiens
accccaacacttggg

SEQ ID NO: 53119 - DNA, 15 bp, Homo sapiens
ccccaacacttggga

SEQ ID NO: 53120 - DNA, 15 bp, Homo sapiens
cccaacacttgggag

SEQ ID NO: 53121 - DNA, 15 bp, Homo sapiens
ccaacacttgggagg

SEQ ID NO: 53122 - DNA, 15 bp, Homo sapiens
caacacttgggaggc

SEQ ID NO: 53123 - DNA, 15 bp, Homo sapiens
aacacttgggaggcc

SEQ ID NO: 53124 - DNA, 15 bp, Homo sapiens
acacttgggaggccg

SEQ ID NO: 53125 - DNA, 15 bp, Homo sapiens
cacttgggaggccga

SEQ ID NO: 53126 - DNA, 15 bp, Homo sapiens
acttgggaggccgag

SEQ ID NO: 53127 - DNA, 15 bp, Homo sapiens
cttgggaggccgagg

SEQ ID NO: 53128 - DNA, 15 bp, Homo sapiens
ggccgaggcaggtga

SEQ ID NO: 53129 - DNA, 15 bp, Homo sapiens
gccgaggcaggtgaa

SEQ ID NO: 53130 - DNA, 15 bp, Homo sapiens
ccgaggcaggtgaat

SEQ ID NO: 53131 - DNA, 15 bp, Homo sapiens
cgaggcaggtgaatc

SEQ ID NO: 53132 - DNA, 15 bp, Homo sapiens
gaggcaggtgaatca

SEQ ID NO: 53133 - DNA, 15 bp, Homo sapiens
aggcaggtgaatcac

SEQ ID NO: 53134 - DNA, 15 bp, Homo sapiens
ggcaggtgaatcact

SEQ ID NO: 53135 - DNA, 15 bp, Homo sapiens
gcaggtgaatcactt

SEQ ID NO: 53136 - DNA, 15 bp, Homo sapiens
caggtgaatcacttg

SEQ ID NO: 53137 - DNA, 15 bp, Homo sapiens
aggtgaatcacttgg

SEQ ID NO: 53138 - DNA, 15 bp, Homo sapiens
ggtgaatcacttggg

SEQ ID NO: 53139 - DNA, 15 bp, Homo sapiens
gtgaatcacttgggg

SEQ ID NO: 53140 - DNA, 15 bp, Homo sapiens
tgaatcacttggggt

SEQ ID NO: 53141 - DNA, 15 bp, Homo sapiens
gaatcacttggggtc

SEQ ID NO: 53142 - DNA, 15 bp, Homo sapiens
aatcacttggggtca

SEQ ID NO: 53143 - DNA, 15 bp, Homo sapiens
atcacttggggtcag

SEQ ID NO: 53144 - DNA, 15 bp, Homo sapiens
tcacttggggtcagg

SEQ ID NO: 53145 - DNA, 15 bp, Homo sapiens
cacttggggtcagga

SEQ ID NO: 53146 - DNA, 15 bp, Homo sapiens
acttggggtcaggag

SEQ ID NO: 53147 - DNA, 15 bp, Homo sapiens
cttggggtcaggagt

SEQ ID NO: 53148 - DNA, 15 bp, Homo sapiens
ttggggtcaggagtt

SEQ ID NO: 53149 - DNA, 15 bp, Homo sapiens
tggggtcaggagttc

SEQ ID NO: 53150 - DNA, 15 bp, Homo sapiens
ggggtcaggagttca

SEQ ID NO: 53151 - DNA, 15 bp, Homo sapiens
gggtcaggagttcaa

SEQ ID NO: 53152 - DNA, 15 bp, Homo sapiens
gtgaaaccccgtctg

SEQ ID NO: 53153 - DNA, 15 bp, Homo sapiens
tgaaaccccgtctgt

SEQ ID NO: 53154 - DNA, 15 bp, Homo sapiens
gaaaccccgtctgta

SEQ ID NO: 53155 - DNA, 15 bp, Homo sapiens
aaaccccgtctgtac

SEQ ID NO: 53156 - DNA, 15 bp, Homo sapiens
aaccccgtctgtact

SEQ ID NO: 53157 - DNA, 15 bp, Homo sapiens
accccgtctgtacta

SEQ ID NO: 53158 - DNA, 15 bp, Homo sapiens
ccccgtctgtactaa

SEQ ID NO: 53159 - DNA, 15 bp, Homo sapiens
cccgtctgtactaaa

SEQ ID NO: 53160 - DNA, 15 bp, Homo sapiens
ccgtctgtactaaaa

SEQ ID NO: 53161 - DNA, 15 bp, Homo sapiens
cgtctgtactaaaaa

SEQ ID NO: 53162 - DNA, 15 bp, Homo sapiens
gtctgtactaaaaat

SEQ ID NO: 53163 - DNA, 15 bp, Homo sapiens
tctgtactaaaaata

SEQ ID NO: 53164 - DNA, 15 bp, Homo sapiens
aaatacaaaaaattg

SEQ ID NO: 53165 - DNA, 15 bp, Homo sapiens
aatacaaaaaattgc

SEQ ID NO: 53166 - DNA, 15 bp, Homo sapiens
atacaaaaaattgct

SEQ ID NO: 53167 - DNA, 15 bp, Homo sapiens
tacaaaaaattgctg

SEQ ID NO: 53168 - DNA, 15 bp, Homo sapiens
acaaaaaattgctgg

SEQ ID NO: 53169 - DNA, 15 bp, Homo sapiens
caaaaaattgctggg

SEQ ID NO: 53170 - DNA, 15 bp, Homo sapiens
aaaaaattgctgggt

SEQ ID NO: 53171 - DNA, 15 bp, Homo sapiens
aaaaattgctgggtg

SEQ ID NO: 53172 - DNA, 15 bp, Homo sapiens
aaaattgctgggtgt

SEQ ID NO: 53173 - DNA, 15 bp, Homo sapiens
aaattgctgggtgtg

SEQ ID NO: 53174 - DNA, 15 bp, Homo sapiens
aattgctgggtgtgg

SEQ ID NO: 53175 - DNA, 15 bp, Homo sapiens
attgctgggtgtggt

SEQ ID NO: 53176 - DNA, 15 bp, Homo sapiens
ttgctgggtgtggtg

SEQ ID NO: 53177 - DNA, 15 bp, Homo sapiens
tgctgggtgtggtgg

SEQ ID NO: 53178 - DNA, 15 bp, Homo sapiens
ctgggtgtggtggtg

SEQ ID NO: 53179 - DNA, 15 bp, Homo sapiens
tgggtgtggtggtgg

SEQ ID NO: 53180 - DNA, 15 bp, Homo sapiens
gggtgtggtggtggg

SEQ ID NO: 53181 - DNA, 15 bp, Homo sapiens
gtgtggtggtgggcg

SEQ ID NO: 53182 - DNA, 15 bp, Homo sapiens
tgtggtggtgggcgc

SEQ ID NO: 53183 - DNA, 15 bp, Homo sapiens
gtggtggtgggcgcc

SEQ ID NO: 53184 - DNA, 15 bp, Homo sapiens
tggtggtgggcgcct

SEQ ID NO: 53185 - DNA, 15 bp, Homo sapiens
ggtggtgggcgcctg

SEQ ID NO: 53186 - DNA, 15 bp, Homo sapiens
gtggtgggcgcctgt

SEQ ID NO: 53187 - DNA, 15 bp, Homo sapiens
tggtgggcgcctgta

SEQ ID NO: 53188 - DNA, 15 bp, Homo sapiens
ggtgggcgcctgtaa

SEQ ID NO: 53189 - DNA, 15 bp, Homo sapiens
gtgggcgcctgtaat

SEQ ID NO: 53190 - DNA, 15 bp, Homo sapiens
tgggcgcctgtaatc

SEQ ID NO: 53191 - DNA, 15 bp, Homo sapiens
gggcgcctgtaatcc

SEQ ID NO: 53192 - DNA, 15 bp, Homo sapiens
ggcgcctgtaatccc

SEQ ID NO: 53193 - DNA, 15 bp, Homo sapiens
gcgcctgtaatccca

SEQ ID NO: 53194 - DNA, 15 bp, Homo sapiens
cagctactcgggaga

SEQ ID NO: 53195 - DNA, 15 bp, Homo sapiens
agctactcgggagat

SEQ ID NO: 53196 - DNA, 15 bp, Homo sapiens
gctactcgggagatt

SEQ ID NO: 53197 - DNA, 15 bp, Homo sapiens
ctactcgggagattg

SEQ ID NO: 53198 - DNA, 15 bp, Homo sapiens
tactcgggagattga

SEQ ID NO: 53199 - DNA, 15 bp, Homo sapiens
actcgggagattgag

SEQ ID NO: 53200 - DNA, 15 bp, Homo sapiens
ctcgggagattgagg

SEQ ID NO: 53201 - DNA, 15 bp, Homo sapiens
tcgggagattgaggc

SEQ ID NO: 53202 - DNA, 15 bp, Homo sapiens
cgggagattgaggca

SEQ ID NO: 53203 - DNA, 15 bp, Homo sapiens
gggagattgaggcag

SEQ ID NO: 53204 - DNA, 15 bp, Homo sapiens
ggagattgaggcagg

SEQ ID NO: 53205 - DNA, 15 bp, Homo sapiens
gagattgaggcagga

SEQ ID NO: 53206 - DNA, 15 bp, Homo sapiens
agattgaggcaggag

SEQ ID NO: 53207 - DNA, 15 bp, Homo sapiens
gattgaggcaggaga

SEQ ID NO: 53208 - DNA, 15 bp, Homo sapiens
attgaggcaggagaa

SEQ ID NO: 53209 - DNA, 15 bp, Homo sapiens
ttgaggcaggagaat

SEQ ID NO: 53210 - DNA, 15 bp, Homo sapiens
gaacccaggaggcgt

SEQ ID NO: 53211 - DNA, 15 bp, Homo sapiens
aacccaggaggcgtg

SEQ ID NO: 53212 - DNA, 15 bp, Homo sapiens
acccaggaggcgtgc

SEQ ID NO: 53213 - DNA, 15 bp, Homo sapiens
cccaggaggcgtgca

SEQ ID NO: 53214 - DNA, 15 bp, Homo sapiens
ccaggaggcgtgcag

SEQ ID NO: 53215 - DNA, 15 bp, Homo sapiens
caggaggcgtgcagt

SEQ ID NO: 53216 - DNA, 15 bp, Homo sapiens
aggaggcgtgcagtg

SEQ ID NO: 53217 - DNA, 15 bp, Homo sapiens
ggaggcgtgcagtga

SEQ ID NO: 53218 - DNA, 15 bp, Homo sapiens
gaggcgtgcagtgag

SEQ ID NO: 53219 - DNA, 15 bp, Homo sapiens
aggcgtgcagtgagc

SEQ ID NO: 53220 - DNA, 15 bp, Homo sapiens
ggcgtgcagtgagcc

SEQ ID NO: 53221 - DNA, 15 bp, Homo sapiens
gcgtgcagtgagccg

SEQ ID NO: 53222 - DNA, 15 bp, Homo sapiens
cgtgcagtgagccga

SEQ ID NO: 53223 - DNA, 15 bp, Homo sapiens
gtgcagtgagccgag

SEQ ID NO: 53224 - DNA, 15 bp, Homo sapiens
cagtgagccgagact

SEQ ID NO: 53225 - DNA, 15 bp, Homo sapiens
agtgagccgagactg

SEQ ID NO: 53226 - DNA, 15 bp, Homo sapiens
gtgagccgagactgc

SEQ ID NO: 53227 - DNA, 15 bp, Homo sapiens
tgagccgagactgcg

SEQ ID NO: 53228 - DNA, 15 bp, Homo sapiens
gagccgagactgcgc

SEQ ID NO: 53229 - DNA, 15 bp, Homo sapiens
agccgagactgcgcc

SEQ ID NO: 53230 - DNA, 15 bp, Homo sapiens
gccgagactgcgcca

SEQ ID NO: 53231 - DNA, 15 bp, Homo sapiens
ccgagactgcgccac

SEQ ID NO: 53232 - DNA, 15 bp, Homo sapiens
cgagactgcgccact

SEQ ID NO: 53233 - DNA, 15 bp, Homo sapiens
gagactgcgccactg

SEQ ID NO: 53234 - DNA, 15 bp, Homo sapiens
agactgcgccactgc

SEQ ID NO: 53235 - DNA, 15 bp, Homo sapiens
gactgcgccactgca

SEQ ID NO: 53236 - DNA, 15 bp, Homo sapiens
actgcgccactgcac

SEQ ID NO: 53237 - DNA, 15 bp, Homo sapiens
ctgcgccactgcact

SEQ ID NO: 53238 - DNA, 15 bp, Homo sapiens
tgcgccactgcacta

SEQ ID NO: 53239 - DNA, 15 bp, Homo sapiens
gcgccactgcactac

SEQ ID NO: 53240 - DNA, 15 bp, Homo sapiens
cgccactgcactaca

SEQ ID NO: 53241 - DNA, 15 bp, Homo sapiens
gccactgcactacag

SEQ ID NO: 53242 - DNA, 15 bp, Homo sapiens
ccactgcactacagc

SEQ ID NO: 53243 - DNA, 15 bp, Homo sapiens
cactgcactacagcc

SEQ ID NO: 53244 - DNA, 15 bp, Homo sapiens
actgcactacagcct

SEQ ID NO: 53245 - DNA, 15 bp, Homo sapiens
ctgcactacagcctg

SEQ ID NO: 53246 - DNA, 15 bp, Homo sapiens
actacagcctgggcg

SEQ ID NO: 53247 - DNA, 15 bp, Homo sapiens
ctacagcctgggcga

SEQ ID NO: 53248 - DNA, 15 bp, Homo sapiens
tacagcctgggcgac

SEQ ID NO: 53249 - DNA, 15 bp, Homo sapiens
acagcctgggcgaca

SEQ ID NO: 53250 - DNA, 15 bp, Homo sapiens
ctgggcgacagagcg

SEQ ID NO: 53251 - DNA, 15 bp, Homo sapiens
tgggcgacagagcgg

SEQ ID NO: 53252 - DNA, 15 bp, Homo sapiens
gggcgacagagcggg

SEQ ID NO: 53253 - DNA, 15 bp, Homo sapiens
ggcgacagagcggga

SEQ ID NO: 53254 - DNA, 15 bp, Homo sapiens
gcgacagagcgggac

SEQ ID NO: 53255 - DNA, 15 bp, Homo sapiens
cgacagagcgggact

SEQ ID NO: 53256 - DNA, 15 bp, Homo sapiens
gacagagcgggactc

SEQ ID NO: 53257 - DNA, 15 bp, Homo sapiens
acagagcgggactcc

SEQ ID NO: 53258 - DNA, 15 bp, Homo sapiens
cagagcgggactcca

SEQ ID NO: 53259 - DNA, 15 bp, Homo sapiens
agagcgggactccat

SEQ ID NO: 53260 - DNA, 15 bp, Homo sapiens
gagcgggactccatc

SEQ ID NO: 53261 - DNA, 15 bp, Homo sapiens
agcgggactccatct

SEQ ID NO: 53262 - DNA, 15 bp, Homo sapiens
gcgggactccatctc

SEQ ID NO: 53263 - DNA, 15 bp, Homo sapiens
cgggactccatctca

SEQ ID NO: 53264 - DNA, 15 bp, Homo sapiens
gggactccatctcag

SEQ ID NO: 53265 - DNA, 15 bp, Homo sapiens
ggactccatctcaga

SEQ ID NO: 53266 - DNA, 15 bp, Homo sapiens
gactccatctcagaa

SEQ ID NO: 53267 - DNA, 15 bp, Homo sapiens
actccatctcagaaa

SEQ ID NO: 53268 - DNA, 15 bp, Homo sapiens
ctccatctcagaaaa

SEQ ID NO: 53269 - DNA, 15 bp, Homo sapiens
tccatctcagaaaaa

SEQ ID NO: 53270 - DNA, 15 bp, Homo sapiens
ccatctcagaaaaat

SEQ ID NO: 53271 - DNA, 15 bp, Homo sapiens
catctcagaaaaata

SEQ ID NO: 53272 - DNA, 15 bp, Homo sapiens
atctcagaaaaataa

SEQ ID NO: 53273 - DNA, 15 bp, Homo sapiens
tctcagaaaaataaa

SEQ ID NO: 53274 - DNA, 15 bp, Homo sapiens
ctcagaaaaataaaa

SEQ ID NO: 53275 - DNA, 15 bp, Homo sapiens
tcagaaaaataaaaa

SEQ ID NO: 53276 - DNA, 15 bp, Homo sapiens
cagaaaaataaaaat

SEQ ID NO: 53277 - DNA, 15 bp, Homo sapiens
agaaaaataaaaatt

SEQ ID NO: 53278 - DNA, 15 bp, Homo sapiens
gaaaaataaaaattt

SEQ ID NO: 53279 - DNA, 15 bp, Homo sapiens
aaaaataaaaatttg

SEQ ID NO: 53280 - DNA, 15 bp, Homo sapiens
aaaataaaaatttgc

SEQ ID NO: 53281 - DNA, 15 bp, Homo sapiens
aaataaaaatttgca

SEQ ID NO: 53282 - DNA, 15 bp, Homo sapiens
aataaaaatttgcat

SEQ ID NO: 53283 - DNA, 15 bp, Homo sapiens
ataaaaatttgcata

SEQ ID NO: 53284 - DNA, 15 bp, Homo sapiens
taaaaatttgcatat

SEQ ID NO: 53285 - DNA, 15 bp, Homo sapiens
aaaaatttgcatatt

SEQ ID NO: 53286 - DNA, 15 bp, Homo sapiens
aaaatttgcatattt

SEQ ID NO: 53287 - DNA, 15 bp, Homo sapiens
aaatttgcatatttt

SEQ ID NO: 53288 - DNA, 15 bp, Homo sapiens
aatttgcatattttt

SEQ ID NO: 53289 - DNA, 15 bp, Homo sapiens
atttgcatatttttg

SEQ ID NO: 53290 - DNA, 15 bp, Homo sapiens
tttgcatatttttgc

SEQ ID NO: 53291 - DNA, 15 bp, Homo sapiens
ttgcatatttttgca

SEQ ID NO: 53292 - DNA, 15 bp, Homo sapiens
tgcatatttttgcaa

SEQ ID NO: 53293 - DNA, 15 bp, Homo sapiens
gcatatttttgcaat

SEQ ID NO: 53294 - DNA, 15 bp, Homo sapiens
catatttttgcaatc

SEQ ID NO: 53295 - DNA, 15 bp, Homo sapiens
atatttttgcaatct

SEQ ID NO: 53296 - DNA, 15 bp, Homo sapiens
tatttttgcaatctg

SEQ ID NO: 53297 - DNA, 15 bp, Homo sapiens
atttttgcaatctgc

SEQ ID NO: 53298 - DNA, 15 bp, Homo sapiens
tttttgcaatctgca

SEQ ID NO: 53299 - DNA, 15 bp, Homo sapiens
ttttgcaatctgcat

SEQ ID NO: 53300 - DNA, 15 bp, Homo sapiens
tttgcaatctgcatc

SEQ ID NO: 53301 - DNA, 15 bp, Homo sapiens
ttgcaatctgcatct

SEQ ID NO: 53302 - DNA, 15 bp, Homo sapiens
tgcaatctgcatctt

SEQ ID NO: 53303 - DNA, 15 bp, Homo sapiens
gcaatctgcatcttt

SEQ ID NO: 53304 - DNA, 15 bp, Homo sapiens
caatctgcatctttc

SEQ ID NO: 53305 - DNA, 15 bp, Homo sapiens
aatctgcatctttct

SEQ ID NO: 53306 - DNA, 15 bp, Homo sapiens
atctgcatctttcta

SEQ ID NO: 53307 - DNA, 15 bp, Homo sapiens
tctgcatctttctac

SEQ ID NO: 53308 - DNA, 15 bp, Homo sapiens
ctgcatctttctact

SEQ ID NO: 53309 - DNA, 15 bp, Homo sapiens
tgcatctttctactt

SEQ ID NO: 53310 - DNA, 15 bp, Homo sapiens
gcatctttctacttg

SEQ ID NO: 53311 - DNA, 15 bp, Homo sapiens
catctttctacttga

SEQ ID NO: 53312 - DNA, 15 bp, Homo sapiens
atctttctacttgaa

SEQ ID NO: 53313 - DNA, 15 bp, Homo sapiens
tctttctacttgaaa

SEQ ID NO: 53314 - DNA, 15 bp, Homo sapiens
ctttctacttgaaat

SEQ ID NO: 53315 - DNA, 15 bp, Homo sapiens
tttctacttgaaatt

SEQ ID NO: 53316 - DNA, 15 bp, Homo sapiens
ttctacttgaaattt

SEQ ID NO: 53317 - DNA, 15 bp, Homo sapiens
tctacttgaaattta

SEQ ID NO: 53318 - DNA, 15 bp, Homo sapiens
ctacttgaaatttat

SEQ ID NO: 53319 - DNA, 15 bp, Homo sapiens
tacttgaaatttatc

SEQ ID NO: 53320 - DNA, 15 bp, Homo sapiens
acttgaaatttatcc

SEQ ID NO: 53321 - DNA, 15 bp, Homo sapiens
cttgaaatttatcca

SEQ ID NO: 53322 - DNA, 15 bp, Homo sapiens
ttgaaatttatccat

SEQ ID NO: 53323 - DNA, 15 bp, Homo sapiens
tgaaatttatccatg

SEQ ID NO: 53324 - DNA, 15 bp, Homo sapiens
gaaatttatccatgt

SEQ ID NO: 53325 - DNA, 15 bp, Homo sapiens
aaatttatccatgtg

SEQ ID NO: 53326 - DNA, 15 bp, Homo sapiens
aatttatccatgtgg

SEQ ID NO: 53327 - DNA, 15 bp, Homo sapiens
atttatccatgtgga

SEQ ID NO: 53328 - DNA, 15 bp, Homo sapiens
tttatccatgtggat

SEQ ID NO: 53329 - DNA, 15 bp, Homo sapiens
ttatccatgtggata

SEQ ID NO: 53330 - DNA, 15 bp, Homo sapiens
tatccatgtggatac

SEQ ID NO: 53331 - DNA, 15 bp, Homo sapiens
atccatgtggataca

SEQ ID NO: 53332 - DNA, 15 bp, Homo sapiens
tccatgtggatacaa

SEQ ID NO: 53333 - DNA, 15 bp, Homo sapiens
ccatgtggatacaag

SEQ ID NO: 53334 - DNA, 15 bp, Homo sapiens
catgtggatacaagt

SEQ ID NO: 53335 - DNA, 15 bp, Homo sapiens
atgtggatacaagtg

SEQ ID NO: 53336 - DNA, 15 bp, Homo sapiens
tgtggatacaagtgc

SEQ ID NO: 53337 - DNA, 15 bp, Homo sapiens
gtggatacaagtgct

SEQ ID NO: 53338 - DNA, 15 bp, Homo sapiens
tggatacaagtgctt

SEQ ID NO: 53339 - DNA, 15 bp, Homo sapiens
ggatacaagtgcttc

SEQ ID NO: 53340 - DNA, 15 bp, Homo sapiens
gatacaagtgcttcc

SEQ ID NO: 53341 - DNA, 15 bp, Homo sapiens
atacaagtgcttcct

SEQ ID NO: 53342 - DNA, 15 bp, Homo sapiens
tacaagtgcttcctc

SEQ ID NO: 53343 - DNA, 15 bp, Homo sapiens
acaagtgcttcctct

SEQ ID NO: 53344 - DNA, 15 bp, Homo sapiens
caagtgcttcctctt

SEQ ID NO: 53345 - DNA, 15 bp, Homo sapiens
aagtgcttcctcttg

SEQ ID NO: 53346 - DNA, 15 bp, Homo sapiens
agtgcttcctcttga

SEQ ID NO: 53347 - DNA, 15 bp, Homo sapiens
gtgcttcctcttgac

SEQ ID NO: 53348 - DNA, 15 bp, Homo sapiens
tgcttcctcttgact

SEQ ID NO: 53349 - DNA, 15 bp, Homo sapiens
gcttcctcttgactg

SEQ ID NO: 53350 - DNA, 15 bp, Homo sapiens
cttcctcttgactgc

SEQ ID NO: 53351 - DNA, 15 bp, Homo sapiens
ttcctcttgactgcc

SEQ ID NO: 53352 - DNA, 15 bp, Homo sapiens
tcctcttgactgcca

SEQ ID NO: 53353 - DNA, 15 bp, Homo sapiens
cctcttgactgccac

SEQ ID NO: 53354 - DNA, 15 bp, Homo sapiens
ctcttgactgccaca

SEQ ID NO: 53355 - DNA, 15 bp, Homo sapiens
tcttgactgccacat

SEQ ID NO: 53356 - DNA, 15 bp, Homo sapiens
cttgactgccacata

SEQ ID NO: 53357 - DNA, 15 bp, Homo sapiens
ttgactgccacatag

SEQ ID NO: 53358 - DNA, 15 bp, Homo sapiens
tgactgccacatagg

SEQ ID NO: 53359 - DNA, 15 bp, Homo sapiens
gactgccacataggt

SEQ ID NO: 53360 - DNA, 15 bp, Homo sapiens
actgccacataggtt

SEQ ID NO: 53361 - DNA, 15 bp, Homo sapiens
ctgccacataggttg

SEQ ID NO: 53362 - DNA, 15 bp, Homo sapiens
tgccacataggttgt

SEQ ID NO: 53363 - DNA, 15 bp, Homo sapiens
gccacataggttgtg

SEQ ID NO: 53364 - DNA, 15 bp, Homo sapiens
ccacataggttgtgt

SEQ ID NO: 53365 - DNA, 15 bp, Homo sapiens
cacataggttgtgtt

SEQ ID NO: 53366 - DNA, 15 bp, Homo sapiens
acataggttgtgttt

SEQ ID NO: 53367 - DNA, 15 bp, Homo sapiens
cataggttgtgtttt

SEQ ID NO: 53368 - DNA, 15 bp, Homo sapiens
ataggttgtgttttt

SEQ ID NO: 53369 - DNA, 15 bp, Homo sapiens
taggttgtgtttttg

SEQ ID NO: 53370 - DNA, 15 bp, Homo sapiens
aggttgtgtttttgt

SEQ ID NO: 53371 - DNA, 15 bp, Homo sapiens
ggttgtgtttttgtt

SEQ ID NO: 53372 - DNA, 15 bp, Homo sapiens
gttgtgtttttgttt

SEQ ID NO: 53373 - DNA, 15 bp, Homo sapiens
ttgtgtttttgtttt

SEQ ID NO: 53374 - DNA, 15 bp, Homo sapiens
tgtgtttttgttttt

SEQ ID NO: 53375 - DNA, 15 bp, Homo sapiens
gtgtttttgttttta

SEQ ID NO: 53376 - DNA, 15 bp, Homo sapiens
tgtttttgtttttag

SEQ ID NO: 53377 - DNA, 15 bp, Homo sapiens
gtttttgtttttagt

SEQ ID NO: 53378 - DNA, 15 bp, Homo sapiens
tttttgtttttagta

SEQ ID NO: 53379 - DNA, 15 bp, Homo sapiens
ttttgtttttagtaa

SEQ ID NO: 53380 - DNA, 15 bp, Homo sapiens
tttgtttttagtaag

SEQ ID NO: 53381 - DNA, 15 bp, Homo sapiens
ttgtttttagtaaga

SEQ ID NO: 53382 - DNA, 15 bp, Homo sapiens
tgtttttagtaagat

SEQ ID NO: 53383 - DNA, 15 bp, Homo sapiens
gtttttagtaagata

SEQ ID NO: 53384 - DNA, 15 bp, Homo sapiens
tttttagtaagataa

SEQ ID NO: 53385 - DNA, 15 bp, Homo sapiens
ttttagtaagataat

SEQ ID NO: 53386 - DNA, 15 bp, Homo sapiens
tttagtaagataata

SEQ ID NO: 53387 - DNA, 15 bp, Homo sapiens
ttagtaagataatac

SEQ ID NO: 53388 - DNA, 15 bp, Homo sapiens
tagtaagataataca

SEQ ID NO: 53389 - DNA, 15 bp, Homo sapiens
agtaagataatacag

SEQ ID NO: 53390 - DNA, 15 bp, Homo sapiens
gtaagataatacaga

SEQ ID NO: 53391 - DNA, 15 bp, Homo sapiens
taagataatacagat

SEQ ID NO: 53392 - DNA, 15 bp, Homo sapiens
aagataatacagata

SEQ ID NO: 53393 - DNA, 15 bp, Homo sapiens
agataatacagataa

SEQ ID NO: 53394 - DNA, 15 bp, Homo sapiens
gataatacagataaa

SEQ ID NO: 53395 - DNA, 15 bp, Homo sapiens
ataatacagataaat

SEQ ID NO: 53396 - DNA, 15 bp, Homo sapiens
taatacagataaatt

SEQ ID NO: 53397 - DNA, 15 bp, Homo sapiens
aatacagataaattt

SEQ ID NO: 53398 - DNA, 15 bp, Homo sapiens
atacagataaatttg

SEQ ID NO: 53399 - DNA, 15 bp, Homo sapiens
tacagataaatttga

SEQ ID NO: 53400 - DNA, 15 bp, Homo sapiens
acagataaatttgaa

SEQ ID NO: 53401 - DNA, 15 bp, Homo sapiens
cagataaatttgaag

SEQ ID NO: 53402 - DNA, 15 bp, Homo sapiens
agataaatttgaagt

SEQ ID NO: 53403 - DNA, 15 bp, Homo sapiens
gataaatttgaagtc

SEQ ID NO: 53404 - DNA, 15 bp, Homo sapiens
ataaatttgaagtcc

SEQ ID NO: 53405 - DNA, 15 bp, Homo sapiens
taaatttgaagtccc

SEQ ID NO: 53406 - DNA, 15 bp, Homo sapiens
aaatttgaagtcccc

SEQ ID NO: 53407 - DNA, 15 bp, Homo sapiens
aatttgaagtcccct

SEQ ID NO: 53408 - DNA, 15 bp, Homo sapiens
atttgaagtcccctt

SEQ ID NO: 53409 - DNA, 15 bp, Homo sapiens
tttgaagtccccttt

SEQ ID NO: 53410 - DNA, 15 bp, Homo sapiens
ttgaagtcccctttg

SEQ ID NO: 53411 - DNA, 15 bp, Homo sapiens
tgaagtcccctttgt

SEQ ID NO: 53412 - DNA, 15 bp, Homo sapiens
gaagtcccctttgtc

SEQ ID NO: 53413 - DNA, 15 bp, Homo sapiens
aagtcccctttgtcc

SEQ ID NO: 53414 - DNA, 15 bp, Homo sapiens
agtcccctttgtccc

SEQ ID NO: 53415 - DNA, 15 bp, Homo sapiens
gtcccctttgtccca

SEQ ID NO: 53416 - DNA, 15 bp, Homo sapiens
tcccctttgtcccac

SEQ ID NO: 53417 - DNA, 15 bp, Homo sapiens
cccctttgtcccact

SEQ ID NO: 53418 - DNA, 15 bp, Homo sapiens
ccctttgtcccactt

SEQ ID NO: 53419 - DNA, 15 bp, Homo sapiens
cctttgtcccacttc

SEQ ID NO: 53420 - DNA, 15 bp, Homo sapiens
ctttgtcccacttcg

SEQ ID NO: 53421 - DNA, 15 bp, Homo sapiens
tttgtcccacttcgg

SEQ ID NO: 53422 - DNA, 15 bp, Homo sapiens
ttgtcccacttcggt

SEQ ID NO: 53423 - DNA, 15 bp, Homo sapiens
tgtcccacttcggta

SEQ ID NO: 53424 - DNA, 15 bp, Homo sapiens
gtcccacttcggtaa

SEQ ID NO: 53425 - DNA, 15 bp, Homo sapiens
tcccacttcggtaaa

SEQ ID NO: 53426 - DNA, 15 bp, Homo sapiens
cccacttcggtaaac

SEQ ID NO: 53427 - DNA, 15 bp, Homo sapiens
ccacttcggtaaact

SEQ ID NO: 53428 - DNA, 15 bp, Homo sapiens
cacttcggtaaactt

SEQ ID NO: 53429 - DNA, 15 bp, Homo sapiens
acttcggtaaactta

SEQ ID NO: 53430 - DNA, 15 bp, Homo sapiens
cttcggtaaacttat

SEQ ID NO: 53431 - DNA, 15 bp, Homo sapiens
ttcggtaaacttatt

SEQ ID NO: 53432 - DNA, 15 bp, Homo sapiens
tcggtaaacttattt

SEQ ID NO: 53433 - DNA, 15 bp, Homo sapiens
cggtaaacttatttg

SEQ ID NO: 53434 - DNA, 15 bp, Homo sapiens
ggtaaacttatttgg

SEQ ID NO: 53435 - DNA, 15 bp, Homo sapiens
gtaaacttatttggt

SEQ ID NO: 53436 - DNA, 15 bp, Homo sapiens
taaacttatttggta

SEQ ID NO: 53437 - DNA, 15 bp, Homo sapiens
aaacttatttggtaa

SEQ ID NO: 53438 - DNA, 15 bp, Homo sapiens
aacttatttggtaat

SEQ ID NO: 53439 - DNA, 15 bp, Homo sapiens
acttatttggtaatt

SEQ ID NO: 53440 - DNA, 15 bp, Homo sapiens
cttatttggtaattt

SEQ ID NO: 53441 - DNA, 15 bp, Homo sapiens
ttatttggtaatttt

SEQ ID NO: 53442 - DNA, 15 bp, Homo sapiens
tatttggtaatttta

SEQ ID NO: 53443 - DNA, 15 bp, Homo sapiens
atttggtaattttac

SEQ ID NO: 53444 - DNA, 15 bp, Homo sapiens
tttggtaattttaca

SEQ ID NO: 53445 - DNA, 15 bp, Homo sapiens
ttggtaattttacat

SEQ ID NO: 53446 - DNA, 15 bp, Homo sapiens
tggtaattttacatt

SEQ ID NO: 53447 - DNA, 15 bp, Homo sapiens
ggtaattttacattt

SEQ ID NO: 53448 - DNA, 15 bp, Homo sapiens
gtaattttacatttc

SEQ ID NO: 53449 - DNA, 15 bp, Homo sapiens
taattttacatttcc

SEQ ID NO: 53450 - DNA, 15 bp, Homo sapiens
aattttacatttcct

SEQ ID NO: 53451 - DNA, 15 bp, Homo sapiens
attttacatttccta

SEQ ID NO: 53452 - DNA, 15 bp, Homo sapiens
ttttacatttcctag

SEQ ID NO: 53453 - DNA, 15 bp, Homo sapiens
tttacatttcctagg

SEQ ID NO: 53454 - DNA, 15 bp, Homo sapiens
ttacatttcctaggt

SEQ ID NO: 53455 - DNA, 15 bp, Homo sapiens
tacatttcctaggta

SEQ ID NO: 53456 - DNA, 15 bp, Homo sapiens
acatttcctaggtaa

SEQ ID NO: 53457 - DNA, 15 bp, Homo sapiens
catttcctaggtaaa

SEQ ID NO: 53458 - DNA, 15 bp, Homo sapiens
atttcctaggtaaaa

SEQ ID NO: 53459 - DNA, 15 bp, Homo sapiens
tttcctaggtaaaat

SEQ ID NO: 53460 - DNA, 15 bp, Homo sapiens
ttcctaggtaaaatg

SEQ ID NO: 53461 - DNA, 15 bp, Homo sapiens
tcctaggtaaaatgt

SEQ ID NO: 53462 - DNA, 15 bp, Homo sapiens
cctaggtaaaatgtg

SEQ ID NO: 53463 - DNA, 15 bp, Homo sapiens
ctaggtaaaatgtgt

SEQ ID NO: 53464 - DNA, 15 bp, Homo sapiens
taggtaaaatgtgtt

SEQ ID NO: 53465 - DNA, 15 bp, Homo sapiens
aggtaaaatgtgttt

SEQ ID NO: 53466 - DNA, 15 bp, Homo sapiens
ggtaaaatgtgtttt

SEQ ID NO: 53467 - DNA, 15 bp, Homo sapiens
gtaaaatgtgttttg

SEQ ID NO: 53468 - DNA, 15 bp, Homo sapiens
taaaatgtgttttgt

SEQ ID NO: 53469 - DNA, 15 bp, Homo sapiens
aaaatgtgttttgtg

SEQ ID NO: 53470 - DNA, 15 bp, Homo sapiens
aaatgtgttttgtga

SEQ ID NO: 53471 - DNA, 15 bp, Homo sapiens
aatgtgttttgtgac

SEQ ID NO: 53472 - DNA, 15 bp, Homo sapiens
atgtgttttgtgaca

SEQ ID NO: 53473 - DNA, 15 bp, Homo sapiens
tgtgttttgtgacac

SEQ ID NO: 53474 - DNA, 15 bp, Homo sapiens
gtgttttgtgacacc

SEQ ID NO: 53475 - DNA, 15 bp, Homo sapiens
tgttttgtgacacca

SEQ ID NO: 53476 - DNA, 15 bp, Homo sapiens
gttttgtgacaccaa

SEQ ID NO: 53477 - DNA, 15 bp, Homo sapiens
ttttgtgacaccaac

SEQ ID NO: 53478 - DNA, 15 bp, Homo sapiens
tttgtgacaccaact

SEQ ID NO: 53479 - DNA, 15 bp, Homo sapiens
ttgtgacaccaactt

SEQ ID NO: 53480 - DNA, 15 bp, Homo sapiens
tgtgacaccaactta

SEQ ID NO: 53481 - DNA, 15 bp, Homo sapiens
gtgacaccaacttat

SEQ ID NO: 53482 - DNA, 15 bp, Homo sapiens
tgacaccaacttatg

SEQ ID NO: 53483 - DNA, 15 bp, Homo sapiens
gacaccaacttatga

SEQ ID NO: 53484 - DNA, 15 bp, Homo sapiens
acaccaacttatgaa

SEQ ID NO: 53485 - DNA, 15 bp, Homo sapiens
caccaacttatgaaa

SEQ ID NO: 53486 - DNA, 15 bp, Homo sapiens
accaacttatgaaac

SEQ ID NO: 53487 - DNA, 15 bp, Homo sapiens
ccaacttatgaaaca

SEQ ID NO: 53488 - DNA, 15 bp, Homo sapiens
caacttatgaaacaa

SEQ ID NO: 53489 - DNA, 15 bp, Homo sapiens
aacttatgaaacaaa

SEQ ID NO: 53490 - DNA, 15 bp, Homo sapiens
acttatgaaacaaaa

SEQ ID NO: 53491 - DNA, 15 bp, Homo sapiens
cttatgaaacaaaaa

SEQ ID NO: 53492 - DNA, 15 bp, Homo sapiens
ttatgaaacaaaaat

SEQ ID NO: 53493 - DNA, 15 bp, Homo sapiens
tatgaaacaaaaatt

SEQ ID NO: 53494 - DNA, 15 bp, Homo sapiens
atgaaacaaaaattc

SEQ ID NO: 53495 - DNA, 15 bp, Homo sapiens
tgaaacaaaaattct

SEQ ID NO: 53496 - DNA, 15 bp, Homo sapiens
gaaacaaaaattcta

SEQ ID NO: 53497 - DNA, 15 bp, Homo sapiens
aaacaaaaattctaa

SEQ ID NO: 53498 - DNA, 15 bp, Homo sapiens
aacaaaaattctaaa

SEQ ID NO: 53499 - DNA, 15 bp, Homo sapiens
acaaaaattctaaaa

SEQ ID NO: 53500 - DNA, 15 bp, Homo sapiens
caaaaattctaaaac

SEQ ID NO: 53501 - DNA, 15 bp, Homo sapiens
aaaaattctaaaact

SEQ ID NO: 53502 - DNA, 15 bp, Homo sapiens
aaaattctaaaactc

SEQ ID NO: 53503 - DNA, 15 bp, Homo sapiens
aaattctaaaactct

SEQ ID NO: 53504 - DNA, 15 bp, Homo sapiens
aattctaaaactctt

SEQ ID NO: 53505 - DNA, 15 bp, Homo sapiens
attctaaaactcttt

SEQ ID NO: 53506 - DNA, 15 bp, Homo sapiens
ttctaaaactctttg

SEQ ID NO: 53507 - DNA, 15 bp, Homo sapiens
tctaaaactctttgc

SEQ ID NO: 53508 - DNA, 15 bp, Homo sapiens
ctaaaactctttgcc

SEQ ID NO: 53509 - DNA, 15 bp, Homo sapiens
taaaactctttgcca

SEQ ID NO: 53510 - DNA, 15 bp, Homo sapiens
aaaactctttgccaa

SEQ ID NO: 53511 - DNA, 15 bp, Homo sapiens
aaactctttgccaag

SEQ ID NO: 53512 - DNA, 15 bp, Homo sapiens
aactctttgccaaga

SEQ ID NO: 53513 - DNA, 15 bp, Homo sapiens
actctttgccaagag

SEQ ID NO: 53514 - DNA, 15 bp, Homo sapiens
ctctttgccaagaga

SEQ ID NO: 53515 - DNA, 15 bp, Homo sapiens
tctttgccaagagac

SEQ ID NO: 53516 - DNA, 15 bp, Homo sapiens
ctttgccaagagacc

SEQ ID NO: 53517 - DNA, 15 bp, Homo sapiens
tttgccaagagacct

SEQ ID NO: 53518 - DNA, 15 bp, Homo sapiens
ttgccaagagaccta

SEQ ID NO: 53519 - DNA, 15 bp, Homo sapiens
tgccaagagacctac

SEQ ID NO: 53520 - DNA, 15 bp, Homo sapiens
gccaagagacctacg

SEQ ID NO: 53521 - DNA, 15 bp, Homo sapiens
ccaagagacctacgg

SEQ ID NO: 53522 - DNA, 15 bp, Homo sapiens
caagagacctacggc

SEQ ID NO: 53523 - DNA, 15 bp, Homo sapiens
aagagacctacggct

SEQ ID NO: 53524 - DNA, 15 bp, Homo sapiens
agagacctacggctc

SEQ ID NO: 53525 - DNA, 15 bp, Homo sapiens
gagacctacggctct

SEQ ID NO: 53526 - DNA, 15 bp, Homo sapiens
agacctacggctcta

SEQ ID NO: 53527 - DNA, 15 bp, Homo sapiens
gacctacggctctat

SEQ ID NO: 53528 - DNA, 15 bp, Homo sapiens
acctacggctctatt

SEQ ID NO: 53529 - DNA, 15 bp, Homo sapiens
cctacggctctattc

SEQ ID NO: 53530 - DNA, 15 bp, Homo sapiens
ctacggctctattca

SEQ ID NO: 53531 - DNA, 15 bp, Homo sapiens
tacggctctattcat

SEQ ID NO: 53532 - DNA, 15 bp, Homo sapiens
acggctctattcatt

SEQ ID NO: 53533 - DNA, 15 bp, Homo sapiens
cggctctattcattt

SEQ ID NO: 53534 - DNA, 15 bp, Homo sapiens
ggctctattcatttt

SEQ ID NO: 53535 - DNA, 15 bp, Homo sapiens
gctctattcattttc

SEQ ID NO: 53536 - DNA, 15 bp, Homo sapiens
ctctattcattttcc

SEQ ID NO: 53537 - DNA, 15 bp, Homo sapiens
tctattcattttcct

SEQ ID NO: 53538 - DNA, 15 bp, Homo sapiens
ctattcattttcctc

SEQ ID NO: 53539 - DNA, 15 bp, Homo sapiens
tattcattttcctcc

SEQ ID NO: 53540 - DNA, 15 bp, Homo sapiens
attcattttcctcct

SEQ ID NO: 53541 - DNA, 15 bp, Homo sapiens
ttcattttcctcctg

SEQ ID NO: 53542 - DNA, 15 bp, Homo sapiens
tcattttcctcctgc

SEQ ID NO: 53543 - DNA, 15 bp, Homo sapiens
cattttcctcctgct

SEQ ID NO: 53544 - DNA, 15 bp, Homo sapiens
attttcctcctgctt

SEQ ID NO: 53545 - DNA, 15 bp, Homo sapiens
ttttcctcctgcttc

SEQ ID NO: 53546 - DNA, 15 bp, Homo sapiens
tttcctcctgcttcc

SEQ ID NO: 53547 - DNA, 15 bp, Homo sapiens
ttcctcctgcttccc

SEQ ID NO: 53548 - DNA, 15 bp, Homo sapiens
tcctcctgcttccca

SEQ ID NO: 53549 - DNA, 15 bp, Homo sapiens
cctcctgcttcccat

SEQ ID NO: 53550 - DNA, 15 bp, Homo sapiens
ctcctgcttcccatt

SEQ ID NO: 53551 - DNA, 15 bp, Homo sapiens
tcctgcttcccattc

SEQ ID NO: 53552 - DNA, 15 bp, Homo sapiens
cctgcttcccattca

SEQ ID NO: 53553 - DNA, 15 bp, Homo sapiens
ctgcttcccattcag

SEQ ID NO: 53554 - DNA, 15 bp, Homo sapiens
tgcttcccattcagt

SEQ ID NO: 53555 - DNA, 15 bp, Homo sapiens
gcttcccattcagtg

SEQ ID NO: 53556 - DNA, 15 bp, Homo sapiens
cttcccattcagtgg

SEQ ID NO: 53557 - DNA, 15 bp, Homo sapiens
ttcccattcagtggg

SEQ ID NO: 53558 - DNA, 15 bp, Homo sapiens
tcccattcagtgggc

SEQ ID NO: 53559 - DNA, 15 bp, Homo sapiens
cccattcagtgggct

SEQ ID NO: 53560 - DNA, 15 bp, Homo sapiens
ccattcagtgggctt

SEQ ID NO: 53561 - DNA, 15 bp, Homo sapiens
cattcagtgggcttt

SEQ ID NO: 53562 - DNA, 15 bp, Homo sapiens
attcagtgggctttt

SEQ ID NO: 53563 - DNA, 15 bp, Homo sapiens
ttcagtgggcttttg

SEQ ID NO: 53564 - DNA, 15 bp, Homo sapiens
tcagtgggcttttgc

SEQ ID NO: 53565 - DNA, 15 bp, Homo sapiens
cagtgggcttttgcc

SEQ ID NO: 53566 - DNA, 15 bp, Homo sapiens
agtgggcttttgcct

SEQ ID NO: 53567 - DNA, 15 bp, Homo sapiens
gtgggcttttgccta

SEQ ID NO: 53568 - DNA, 15 bp, Homo sapiens
tgggcttttgcctag

SEQ ID NO: 53569 - DNA, 15 bp, Homo sapiens
gggcttttgcctagg

SEQ ID NO: 53570 - DNA, 15 bp, Homo sapiens
ggcttttgcctaggg

SEQ ID NO: 53571 - DNA, 15 bp, Homo sapiens
gcttttgcctagggg

SEQ ID NO: 53572 - DNA, 15 bp, Homo sapiens
cttttgcctaggggt

SEQ ID NO: 53573 - DNA, 15 bp, Homo sapiens
ttttgcctaggggta

SEQ ID NO: 53574 - DNA, 15 bp, Homo sapiens
tttgcctaggggtat

SEQ ID NO: 53575 - DNA, 15 bp, Homo sapiens
ttgcctaggggtatg

SEQ ID NO: 53576 - DNA, 15 bp, Homo sapiens
tgcctaggggtatga

SEQ ID NO: 53577 - DNA, 15 bp, Homo sapiens
gcctaggggtatgaa

SEQ ID NO: 53578 - DNA, 15 bp, Homo sapiens
cctaggggtatgaat

SEQ ID NO: 53579 - DNA, 15 bp, Homo sapiens
ctaggggtatgaatg

SEQ ID NO: 53580 - DNA, 15 bp, Homo sapiens
taggggtatgaatgt

SEQ ID NO: 53581 - DNA, 15 bp, Homo sapiens
aggggtatgaatgtg

SEQ ID NO: 53582 - DNA, 15 bp, Homo sapiens
ggggtatgaatgtgg

SEQ ID NO: 53583 - DNA, 15 bp, Homo sapiens
gggtatgaatgtggc

SEQ ID NO: 53584 - DNA, 15 bp, Homo sapiens
ggtatgaatgtggca

SEQ ID NO: 53585 - DNA, 15 bp, Homo sapiens
gtatgaatgtggcat

SEQ ID NO: 53586 - DNA, 15 bp, Homo sapiens
tatgaatgtggcatg

SEQ ID NO: 53587 - DNA, 15 bp, Homo sapiens
atgaatgtggcatgc

SEQ ID NO: 53588 - DNA, 15 bp, Homo sapiens
tgaatgtggcatgcc

SEQ ID NO: 53589 - DNA, 15 bp, Homo sapiens
gaatgtggcatgcca

SEQ ID NO: 53590 - DNA, 15 bp, Homo sapiens
aatgtggcatgccag

SEQ ID NO: 53591 - DNA, 15 bp, Homo sapiens
atgtggcatgccagt

SEQ ID NO: 53592 - DNA, 15 bp, Homo sapiens
tgtggcatgccagtt

SEQ ID NO: 53593 - DNA, 15 bp, Homo sapiens
gtggcatgccagttg

SEQ ID NO: 53594 - DNA, 15 bp, Homo sapiens
tggcatgccagttgg

SEQ ID NO: 53595 - DNA, 15 bp, Homo sapiens
ggcatgccagttggc

SEQ ID NO: 53596 - DNA, 15 bp, Homo sapiens
gcatgccagttggct

SEQ ID NO: 53597 - DNA, 15 bp, Homo sapiens
catgccagttggctg

SEQ ID NO: 53598 - DNA, 15 bp, Homo sapiens
atgccagttggctga

SEQ ID NO: 53599 - DNA, 15 bp, Homo sapiens
tgccagttggctgac

SEQ ID NO: 53600 - DNA, 15 bp, Homo sapiens
gccagttggctgacc

SEQ ID NO: 53601 - DNA, 15 bp, Homo sapiens
ccagttggctgaccc

SEQ ID NO: 53602 - DNA, 15 bp, Homo sapiens
cagttggctgaccca

SEQ ID NO: 53603 - DNA, 15 bp, Homo sapiens
agttggctgacccaa

SEQ ID NO: 53604 - DNA, 15 bp, Homo sapiens
gttggctgacccaac

SEQ ID NO: 53605 - DNA, 15 bp, Homo sapiens
ttggctgacccaacc

SEQ ID NO: 53606 - DNA, 15 bp, Homo sapiens
tggctgacccaacca

SEQ ID NO: 53607 - DNA, 15 bp, Homo sapiens
ggctgacccaaccat

SEQ ID NO: 53608 - DNA, 15 bp, Homo sapiens
gctgacccaaccatt

SEQ ID NO: 53609 - DNA, 15 bp, Homo sapiens
ctgacccaaccattg

SEQ ID NO: 53610 - DNA, 15 bp, Homo sapiens
tgacccaaccattgc

SEQ ID NO: 53611 - DNA, 15 bp, Homo sapiens
gacccaaccattgct

SEQ ID NO: 53612 - DNA, 15 bp, Homo sapiens
acccaaccattgctt

SEQ ID NO: 53613 - DNA, 15 bp, Homo sapiens
cccaaccattgcttt

SEQ ID NO: 53614 - DNA, 15 bp, Homo sapiens
ccaaccattgctttc

SEQ ID NO: 53615 - DNA, 15 bp, Homo sapiens
caaccattgctttcc

SEQ ID NO: 53616 - DNA, 15 bp, Homo sapiens
aaccattgctttccc

SEQ ID NO: 53617 - DNA, 15 bp, Homo sapiens
accattgctttccct

SEQ ID NO: 53618 - DNA, 15 bp, Homo sapiens
ccattgctttccctt

SEQ ID NO: 53619 - DNA, 15 bp, Homo sapiens
cattgctttcccttt

SEQ ID NO: 53620 - DNA, 15 bp, Homo sapiens
attgctttccctttc

SEQ ID NO: 53621 - DNA, 15 bp, Homo sapiens
ttgctttccctttca

SEQ ID NO: 53622 - DNA, 15 bp, Homo sapiens
tgctttccctttcag

SEQ ID NO: 53623 - DNA, 15 bp, Homo sapiens
gctttccctttcaga

SEQ ID NO: 53624 - DNA, 15 bp, Homo sapiens
ctttccctttcagac

SEQ ID NO: 53625 - DNA, 15 bp, Homo sapiens
tttccctttcagact

SEQ ID NO: 53626 - DNA, 15 bp, Homo sapiens
ttccctttcagactg

SEQ ID NO: 53627 - DNA, 15 bp, Homo sapiens
tccctttcagactgg

SEQ ID NO: 53628 - DNA, 15 bp, Homo sapiens
ccctttcagactggc

SEQ ID NO: 53629 - DNA, 15 bp, Homo sapiens
cctttcagactggcg

SEQ ID NO: 53630 - DNA, 15 bp, Homo sapiens
ctttcagactggcga

SEQ ID NO: 53631 - DNA, 15 bp, Homo sapiens
tttcagactggcgat

SEQ ID NO: 53632 - DNA, 15 bp, Homo sapiens
ttcagactggcgatg

SEQ ID NO: 53633 - DNA, 15 bp, Homo sapiens
tcagactggcgatgg

SEQ ID NO: 53634 - DNA, 15 bp, Homo sapiens
cagactggcgatggc

SEQ ID NO: 53635 - DNA, 15 bp, Homo sapiens
agactggcgatggcg

SEQ ID NO: 53636 - DNA, 15 bp, Homo sapiens
gactggcgatggcgt

SEQ ID NO: 53637 - DNA, 15 bp, Homo sapiens
actggcgatggcgtg

SEQ ID NO: 53638 - DNA, 15 bp, Homo sapiens
ctggcgatggcgtga

SEQ ID NO: 53639 - DNA, 15 bp, Homo sapiens
tggcgatggcgtgaa

SEQ ID NO: 53640 - DNA, 15 bp, Homo sapiens
ggcgatggcgtgaac

SEQ ID NO: 53641 - DNA, 15 bp, Homo sapiens
gcgatggcgtgaacg

SEQ ID NO: 53642 - DNA, 15 bp, Homo sapiens
cgatggcgtgaacga

SEQ ID NO: 53643 - DNA, 15 bp, Homo sapiens
gatggcgtgaacgat

SEQ ID NO: 53644 - DNA, 15 bp, Homo sapiens
atggcgtgaacgatg

SEQ ID NO: 53645 - DNA, 15 bp, Homo sapiens
tggcgtgaacgatgc

SEQ ID NO: 53646 - DNA, 15 bp, Homo sapiens
ggcgtgaacgatgct

SEQ ID NO: 53647 - DNA, 15 bp, Homo sapiens
gcgtgaacgatgctc

SEQ ID NO: 53648 - DNA, 15 bp, Homo sapiens
cgtgaacgatgctcc

SEQ ID NO: 53649 - DNA, 15 bp, Homo sapiens
gtgaacgatgctcct

SEQ ID NO: 53650 - DNA, 15 bp, Homo sapiens
tgaacgatgctcctg

SEQ ID NO: 53651 - DNA, 15 bp, Homo sapiens
gaacgatgctcctgc

SEQ ID NO: 53652 - DNA, 15 bp, Homo sapiens
aacgatgctcctgct

SEQ ID NO: 53653 - DNA, 15 bp, Homo sapiens
acgatgctcctgctc

SEQ ID NO: 53654 - DNA, 15 bp, Homo sapiens
cgatgctcctgctct

SEQ ID NO: 53655 - DNA, 15 bp, Homo sapiens
gatgctcctgctctg

SEQ ID NO: 53656 - DNA, 15 bp, Homo sapiens
atgctcctgctctga

SEQ ID NO: 53657 - DNA, 15 bp, Homo sapiens
tgctcctgctctgaa

SEQ ID NO: 53658 - DNA, 15 bp, Homo sapiens
gctcctgctctgaag

SEQ ID NO: 53659 - DNA, 15 bp, Homo sapiens
ctcctgctctgaaga

SEQ ID NO: 53660 - DNA, 15 bp, Homo sapiens
tcctgctctgaagaa

SEQ ID NO: 53661 - DNA, 15 bp, Homo sapiens
cctgctctgaagaaa

SEQ ID NO: 53662 - DNA, 15 bp, Homo sapiens
ctgctctgaagaaag

SEQ ID NO: 53663 - DNA, 15 bp, Homo sapiens
tgctctgaagaaagc

SEQ ID NO: 53664 - DNA, 15 bp, Homo sapiens
gctctgaagaaagcc

SEQ ID NO: 53665 - DNA, 15 bp, Homo sapiens
ctctgaagaaagccg

SEQ ID NO: 53666 - DNA, 15 bp, Homo sapiens
tctgaagaaagccga

SEQ ID NO: 53667 - DNA, 15 bp, Homo sapiens
ctgaagaaagccgag

SEQ ID NO: 53668 - DNA, 15 bp, Homo sapiens
tgaagaaagccgaga

SEQ ID NO: 53669 - DNA, 15 bp, Homo sapiens
gaagaaagccgagat

SEQ ID NO: 53670 - DNA, 15 bp, Homo sapiens
aagaaagccgagatt

SEQ ID NO: 53671 - DNA, 15 bp, Homo sapiens
agaaagccgagattg

SEQ ID NO: 53672 - DNA, 15 bp, Homo sapiens
gaaagccgagattgg

SEQ ID NO: 53673 - DNA, 15 bp, Homo sapiens
aaagccgagattggc

SEQ ID NO: 53674 - DNA, 15 bp, Homo sapiens
aagccgagattggca

SEQ ID NO: 53675 - DNA, 15 bp, Homo sapiens
agccgagattggcat

SEQ ID NO: 53676 - DNA, 15 bp, Homo sapiens
gccgagattggcatt

SEQ ID NO: 53677 - DNA, 15 bp, Homo sapiens
ccgagattggcattg

SEQ ID NO: 53678 - DNA, 15 bp, Homo sapiens
cgagattggcattgc

SEQ ID NO: 53679 - DNA, 15 bp, Homo sapiens
gagattggcattgct

SEQ ID NO: 53680 - DNA, 15 bp, Homo sapiens
agattggcattgcta

SEQ ID NO: 53681 - DNA, 15 bp, Homo sapiens
gattggcattgctat

SEQ ID NO: 53682 - DNA, 15 bp, Homo sapiens
attggcattgctatg

SEQ ID NO: 53683 - DNA, 15 bp, Homo sapiens
ttggcattgctatgg

SEQ ID NO: 53684 - DNA, 15 bp, Homo sapiens
tggcattgctatggg

SEQ ID NO: 53685 - DNA, 15 bp, Homo sapiens
ggcattgctatgggc

SEQ ID NO: 53686 - DNA, 15 bp, Homo sapiens
gcattgctatgggct

SEQ ID NO: 53687 - DNA, 15 bp, Homo sapiens
cattgctatgggctc

SEQ ID NO: 53688 - DNA, 15 bp, Homo sapiens
attgctatgggctct

SEQ ID NO: 53689 - DNA, 15 bp, Homo sapiens
ttgctatgggctctg

SEQ ID NO: 53690 - DNA, 15 bp, Homo sapiens
tgctatgggctctgg

SEQ ID NO: 53691 - DNA, 15 bp, Homo sapiens
gctatgggctctggc

SEQ ID NO: 53692 - DNA, 15 bp, Homo sapiens
ctatgggctctggca

SEQ ID NO: 53693 - DNA, 15 bp, Homo sapiens
tatgggctctggcac

SEQ ID NO: 53694 - DNA, 15 bp, Homo sapiens
atgggctctggcact

SEQ ID NO: 53695 - DNA, 15 bp, Homo sapiens
tgggctctggcactg

SEQ ID NO: 53696 - DNA, 15 bp, Homo sapiens
gggctctggcactgc

SEQ ID NO: 53697 - DNA, 15 bp, Homo sapiens
ggctctggcactgcg

SEQ ID NO: 53698 - DNA, 15 bp, Homo sapiens
gctctggcactgcgg

SEQ ID NO: 53699 - DNA, 15 bp, Homo sapiens
ctctggcactgcggt

SEQ ID NO: 53700 - DNA, 15 bp, Homo sapiens
tctggcactgcggtg

SEQ ID NO: 53701 - DNA, 15 bp, Homo sapiens
ctggcactgcggtgg

SEQ ID NO: 53702 - DNA, 15 bp, Homo sapiens
tggcactgcggtggc

SEQ ID NO: 53703 - DNA, 15 bp, Homo sapiens
ggcactgcggtggct

SEQ ID NO: 53704 - DNA, 15 bp, Homo sapiens
gcactgcggtggcta

SEQ ID NO: 53705 - DNA, 15 bp, Homo sapiens
cactgcggtggctaa

SEQ ID NO: 53706 - DNA, 15 bp, Homo sapiens
actgcggtggctaaa

SEQ ID NO: 53707 - DNA, 15 bp, Homo sapiens
ctgcggtggctaaaa

SEQ ID NO: 53708 - DNA, 15 bp, Homo sapiens
tgcggtggctaaaac

SEQ ID NO: 53709 - DNA, 15 bp, Homo sapiens
gcggtggctaaaacc

SEQ ID NO: 53710 - DNA, 15 bp, Homo sapiens
cggtggctaaaaccg

SEQ ID NO: 53711 - DNA, 15 bp, Homo sapiens
ggtggctaaaaccgc

SEQ ID NO: 53712 - DNA, 15 bp, Homo sapiens
gtggctaaaaccgcc

SEQ ID NO: 53713 - DNA, 15 bp, Homo sapiens
tggctaaaaccgcct

SEQ ID NO: 53714 - DNA, 15 bp, Homo sapiens
ggctaaaaccgcctc

SEQ ID NO: 53715 - DNA, 15 bp, Homo sapiens
gctaaaaccgcctct

SEQ ID NO: 53716 - DNA, 15 bp, Homo sapiens
ctaaaaccgcctctg

SEQ ID NO: 53717 - DNA, 15 bp, Homo sapiens
taaaaccgcctctga

SEQ ID NO: 53718 - DNA, 15 bp, Homo sapiens
aaaaccgcctctgag

SEQ ID NO: 53719 - DNA, 15 bp, Homo sapiens
aaaccgcctctgaga

SEQ ID NO: 53720 - DNA, 15 bp, Homo sapiens
aaccgcctctgagat

SEQ ID NO: 53721 - DNA, 15 bp, Homo sapiens
accgcctctgagatg

SEQ ID NO: 53722 - DNA, 15 bp, Homo sapiens
ccgcctctgagatgg

SEQ ID NO: 53723 - DNA, 15 bp, Homo sapiens
cgcctctgagatggt

SEQ ID NO: 53724 - DNA, 15 bp, Homo sapiens
gcctctgagatggtc

SEQ ID NO: 53725 - DNA, 15 bp, Homo sapiens
cctctgagatggtcc

SEQ ID NO: 53726 - DNA, 15 bp, Homo sapiens
ctctgagatggtcct

SEQ ID NO: 53727 - DNA, 15 bp, Homo sapiens
tctgagatggtcctg

SEQ ID NO: 53728 - DNA, 15 bp, Homo sapiens
ctgagatggtcctgg

SEQ ID NO: 53729 - DNA, 15 bp, Homo sapiens
tgagatggtcctggc

SEQ ID NO: 53730 - DNA, 15 bp, Homo sapiens
gagatggtcctggcg

SEQ ID NO: 53731 - DNA, 15 bp, Homo sapiens
agatggtcctggcgg

SEQ ID NO: 53732 - DNA, 15 bp, Homo sapiens
gatggtcctggcgga

SEQ ID NO: 53733 - DNA, 15 bp, Homo sapiens
atggtcctggcggat

SEQ ID NO: 53734 - DNA, 15 bp, Homo sapiens
tggtcctggcggatg

SEQ ID NO: 53735 - DNA, 15 bp, Homo sapiens
ggtcctggcggatga

SEQ ID NO: 53736 - DNA, 15 bp, Homo sapiens
gtcctggcggatgac

SEQ ID NO: 53737 - DNA, 15 bp, Homo sapiens
tcctggcggatgaca

SEQ ID NO: 53738 - DNA, 15 bp, Homo sapiens
cctggcggatgacaa

SEQ ID NO: 53739 - DNA, 15 bp, Homo sapiens
ctggcggatgacaac

SEQ ID NO: 53740 - DNA, 15 bp, Homo sapiens
tggcggatgacaact

SEQ ID NO: 53741 - DNA, 15 bp, Homo sapiens
ggcggatgacaactt

SEQ ID NO: 53742 - DNA, 15 bp, Homo sapiens
gcggatgacaacttc

SEQ ID NO: 53743 - DNA, 15 bp, Homo sapiens
cggatgacaacttct

SEQ ID NO: 53744 - DNA, 15 bp, Homo sapiens
ggatgacaacttctc

SEQ ID NO: 53745 - DNA, 15 bp, Homo sapiens
gatgacaacttctcc

SEQ ID NO: 53746 - DNA, 15 bp, Homo sapiens
atgacaacttctcca

SEQ ID NO: 53747 - DNA, 15 bp, Homo sapiens
tgacaacttctccac

SEQ ID NO: 53748 - DNA, 15 bp, Homo sapiens
gacaacttctccacc

SEQ ID NO: 53749 - DNA, 15 bp, Homo sapiens
acaacttctccacca

SEQ ID NO: 53750 - DNA, 15 bp, Homo sapiens
caacttctccaccat

SEQ ID NO: 53751 - DNA, 15 bp, Homo sapiens
aacttctccaccatt

SEQ ID NO: 53752 - DNA, 15 bp, Homo sapiens
acttctccaccattg

SEQ ID NO: 53753 - DNA, 15 bp, Homo sapiens
cttctccaccattgt

SEQ ID NO: 53754 - DNA, 15 bp, Homo sapiens
ttctccaccattgtg

SEQ ID NO: 53755 - DNA, 15 bp, Homo sapiens
tctccaccattgtgg

SEQ ID NO: 53756 - DNA, 15 bp, Homo sapiens
ctccaccattgtggc

SEQ ID NO: 53757 - DNA, 15 bp, Homo sapiens
tccaccattgtggct

SEQ ID NO: 53758 - DNA, 15 bp, Homo sapiens
ccaccattgtggctg

SEQ ID NO: 53759 - DNA, 15 bp, Homo sapiens
caccattgtggctgc

SEQ ID NO: 53760 - DNA, 15 bp, Homo sapiens
accattgtggctgcc

SEQ ID NO: 53761 - DNA, 15 bp, Homo sapiens
ccattgtggctgccg

SEQ ID NO: 53762 - DNA, 15 bp, Homo sapiens
cattgtggctgccgt

SEQ ID NO: 53763 - DNA, 15 bp, Homo sapiens
attgtggctgccgtt

SEQ ID NO: 53764 - DNA, 15 bp, Homo sapiens
ttgtggctgccgttg

SEQ ID NO: 53765 - DNA, 15 bp, Homo sapiens
tgtggctgccgttga

SEQ ID NO: 53766 - DNA, 15 bp, Homo sapiens
gtggctgccgttgag

SEQ ID NO: 53767 - DNA, 15 bp, Homo sapiens
tggctgccgttgagg

SEQ ID NO: 53768 - DNA, 15 bp, Homo sapiens
ggctgccgttgagga

SEQ ID NO: 53769 - DNA, 15 bp, Homo sapiens
gctgccgttgaggag

SEQ ID NO: 53770 - DNA, 15 bp, Homo sapiens
ctgccgttgaggagg

SEQ ID NO: 53771 - DNA, 15 bp, Homo sapiens
tgccgttgaggaggg

SEQ ID NO: 53772 - DNA, 15 bp, Homo sapiens
gccgttgaggagggg

SEQ ID NO: 53773 - DNA, 15 bp, Homo sapiens
ccgttgaggaggggc

SEQ ID NO: 53774 - DNA, 15 bp, Homo sapiens
cgttgaggaggggcg

SEQ ID NO: 53775 - DNA, 15 bp, Homo sapiens
gttgaggaggggcgg

SEQ ID NO: 53776 - DNA, 15 bp, Homo sapiens
ttgaggaggggcggg

SEQ ID NO: 53777 - DNA, 15 bp, Homo sapiens
tgaggaggggcgggc

SEQ ID NO: 53778 - DNA, 15 bp, Homo sapiens
gaggaggggcgggca

SEQ ID NO: 53779 - DNA, 15 bp, Homo sapiens
aggaggggcgggcaa

SEQ ID NO: 53780 - DNA, 15 bp, Homo sapiens
ggaggggcgggcaat

SEQ ID NO: 53781 - DNA, 15 bp, Homo sapiens
gaggggcgggcaatc

SEQ ID NO: 53782 - DNA, 15 bp, Homo sapiens
aggggcgggcaatct

SEQ ID NO: 53783 - DNA, 15 bp, Homo sapiens
ggggcgggcaatcta

SEQ ID NO: 53784 - DNA, 15 bp, Homo sapiens
gggcgggcaatctac

SEQ ID NO: 53785 - DNA, 15 bp, Homo sapiens
ggcgggcaatctaca

SEQ ID NO: 53786 - DNA, 15 bp, Homo sapiens
gcgggcaatctacaa

SEQ ID NO: 53787 - DNA, 15 bp, Homo sapiens
cgggcaatctacaac

SEQ ID NO: 53788 - DNA, 15 bp, Homo sapiens
gggcaatctacaaca

SEQ ID NO: 53789 - DNA, 15 bp, Homo sapiens
ggcaatctacaacaa

SEQ ID NO: 53790 - DNA, 15 bp, Homo sapiens
gcaatctacaacaac

SEQ ID NO: 53791 - DNA, 15 bp, Homo sapiens
caatctacaacaaca

SEQ ID NO: 53792 - DNA, 15 bp, Homo sapiens
aatctacaacaacat

SEQ ID NO: 53793 - DNA, 15 bp, Homo sapiens
atctacaacaacatg

SEQ ID NO: 53794 - DNA, 15 bp, Homo sapiens
tctacaacaacatga

SEQ ID NO: 53795 - DNA, 15 bp, Homo sapiens
ctacaacaacatgaa

SEQ ID NO: 53796 - DNA, 15 bp, Homo sapiens
tacaacaacatgaaa

SEQ ID NO: 53797 - DNA, 15 bp, Homo sapiens
acaacaacatgaaac

SEQ ID NO: 53798 - DNA, 15 bp, Homo sapiens
caacaacatgaaaca

SEQ ID NO: 53799 - DNA, 15 bp, Homo sapiens
aacaacatgaaacag

SEQ ID NO: 53800 - DNA, 15 bp, Homo sapiens
acaacatgaaacagt

SEQ ID NO: 53801 - DNA, 15 bp, Homo sapiens
caacatgaaacagtt

SEQ ID NO: 53802 - DNA, 15 bp, Homo sapiens
aacatgaaacagttc

SEQ ID NO: 53803 - DNA, 15 bp, Homo sapiens
acatgaaacagttca

SEQ ID NO: 53804 - DNA, 15 bp, Homo sapiens
catgaaacagttcat

SEQ ID NO: 53805 - DNA, 15 bp, Homo sapiens
atgaaacagttcatc

SEQ ID NO: 53806 - DNA, 15 bp, Homo sapiens
tgaaacagttcatcc

SEQ ID NO: 53807 - DNA, 15 bp, Homo sapiens
gaaacagttcatccg

SEQ ID NO: 53808 - DNA, 15 bp, Homo sapiens
aaacagttcatccgc

SEQ ID NO: 53809 - DNA, 15 bp, Homo sapiens
aacagttcatccgct

SEQ ID NO: 53810 - DNA, 15 bp, Homo sapiens
acagttcatccgcta

SEQ ID NO: 53811 - DNA, 15 bp, Homo sapiens
cagttcatccgctac

SEQ ID NO: 53812 - DNA, 15 bp, Homo sapiens
agttcatccgctacc

SEQ ID NO: 53813 - DNA, 15 bp, Homo sapiens
gttcatccgctacct

SEQ ID NO: 53814 - DNA, 15 bp, Homo sapiens
ttcatccgctacctc

SEQ ID NO: 53815 - DNA, 15 bp, Homo sapiens
tcatccgctacctca

SEQ ID NO: 53816 - DNA, 15 bp, Homo sapiens
catccgctacctcat

SEQ ID NO: 53817 - DNA, 15 bp, Homo sapiens
atccgctacctcatc

SEQ ID NO: 53818 - DNA, 15 bp, Homo sapiens
tccgctacctcatct

SEQ ID NO: 53819 - DNA, 15 bp, Homo sapiens
ccgctacctcatctc

SEQ ID NO: 53820 - DNA, 15 bp, Homo sapiens
cgctacctcatctcg

SEQ ID NO: 53821 - DNA, 15 bp, Homo sapiens
gctacctcatctcgt

SEQ ID NO: 53822 - DNA, 15 bp, Homo sapiens
ctacctcatctcgtc

SEQ ID NO: 53823 - DNA, 15 bp, Homo sapiens
tacctcatctcgtcc

SEQ ID NO: 53824 - DNA, 15 bp, Homo sapiens
acctcatctcgtcca

SEQ ID NO: 53825 - DNA, 15 bp, Homo sapiens
cctcatctcgtccaa

SEQ ID NO: 53826 - DNA, 15 bp, Homo sapiens
ctcatctcgtccaac

SEQ ID NO: 53827 - DNA, 15 bp, Homo sapiens
tcatctcgtccaacg

SEQ ID NO: 53828 - DNA, 15 bp, Homo sapiens
catctcgtccaacgt

SEQ ID NO: 53829 - DNA, 15 bp, Homo sapiens
atctcgtccaacgtc

SEQ ID NO: 53830 - DNA, 15 bp, Homo sapiens
tctcgtccaacgtcg

SEQ ID NO: 53831 - DNA, 15 bp, Homo sapiens
ctcgtccaacgtcgg

SEQ ID NO: 53832 - DNA, 15 bp, Homo sapiens
tcgtccaacgtcggg

SEQ ID NO: 53833 - DNA, 15 bp, Homo sapiens
cgtccaacgtcgggg

SEQ ID NO: 53834 - DNA, 15 bp, Homo sapiens
gtccaacgtcgggga

SEQ ID NO: 53835 - DNA, 15 bp, Homo sapiens
tccaacgtcggggaa

SEQ ID NO: 53836 - DNA, 15 bp, Homo sapiens
ccaacgtcggggaag

SEQ ID NO: 53837 - DNA, 15 bp, Homo sapiens
caacgtcggggaagt

SEQ ID NO: 53838 - DNA, 15 bp, Homo sapiens
aacgtcggggaagtt

SEQ ID NO: 53839 - DNA, 15 bp, Homo sapiens
acgtcggggaagttg

SEQ ID NO: 53840 - DNA, 15 bp, Homo sapiens
cgtcggggaagttgt

SEQ ID NO: 53841 - DNA, 15 bp, Homo sapiens
gtcggggaagttgtc

SEQ ID NO: 53842 - DNA, 15 bp, Homo sapiens
tcggggaagttgtct

SEQ ID NO: 53843 - DNA, 15 bp, Homo sapiens
cggggaagttgtctg

SEQ ID NO: 53844 - DNA, 15 bp, Homo sapiens
ggggaagttgtctgg

SEQ ID NO: 53845 - DNA, 15 bp, Homo sapiens
gggaagttgtctggt

SEQ ID NO: 53846 - DNA, 15 bp, Homo sapiens
ggaagttgtctggta

SEQ ID NO: 53847 - DNA, 15 bp, Homo sapiens
gaagttgtctggtag

SEQ ID NO: 53848 - DNA, 15 bp, Homo sapiens
aagttgtctggtagg

SEQ ID NO: 53849 - DNA, 15 bp, Homo sapiens
agttgtctggtaggt

SEQ ID NO: 53850 - DNA, 15 bp, Homo sapiens
gttgtctggtaggtc

SEQ ID NO: 53851 - DNA, 15 bp, Homo sapiens
ttgtctggtaggtct

SEQ ID NO: 53852 - DNA, 15 bp, Homo sapiens
tgtctggtaggtctc

SEQ ID NO: 53853 - DNA, 15 bp, Homo sapiens
gtctggtaggtctct

SEQ ID NO: 53854 - DNA, 15 bp, Homo sapiens
tctggtaggtctctg

SEQ ID NO: 53855 - DNA, 15 bp, Homo sapiens
ctggtaggtctctgt

SEQ ID NO: 53856 - DNA, 15 bp, Homo sapiens
tggtaggtctctgtg

SEQ ID NO: 53857 - DNA, 15 bp, Homo sapiens
ggtaggtctctgtga

SEQ ID NO: 53858 - DNA, 15 bp, Homo sapiens
gtaggtctctgtgac

SEQ ID NO: 53859 - DNA, 15 bp, Homo sapiens
taggtctctgtgaca

SEQ ID NO: 53860 - DNA, 15 bp, Homo sapiens
aggtctctgtgacag

SEQ ID NO: 53861 - DNA, 15 bp, Homo sapiens
ggtctctgtgacagc

SEQ ID NO: 53862 - DNA, 15 bp, Homo sapiens
gtctctgtgacagca

SEQ ID NO: 53863 - DNA, 15 bp, Homo sapiens
tctctgtgacagcat

SEQ ID NO: 53864 - DNA, 15 bp, Homo sapiens
ctctgtgacagcatc

SEQ ID NO: 53865 - DNA, 15 bp, Homo sapiens
tctgtgacagcatca

SEQ ID NO: 53866 - DNA, 15 bp, Homo sapiens
ctgtgacagcatcac

SEQ ID NO: 53867 - DNA, 15 bp, Homo sapiens
tgtgacagcatcact

SEQ ID NO: 53868 - DNA, 15 bp, Homo sapiens
gtgacagcatcactt

SEQ ID NO: 53869 - DNA, 15 bp, Homo sapiens
tgacagcatcactta

SEQ ID NO: 53870 - DNA, 15 bp, Homo sapiens
gacagcatcacttac

SEQ ID NO: 53871 - DNA, 15 bp, Homo sapiens
acagcatcacttact

SEQ ID NO: 53872 - DNA, 15 bp, Homo sapiens
cagcatcacttactg

SEQ ID NO: 53873 - DNA, 15 bp, Homo sapiens
agcatcacttactgt

SEQ ID NO: 53874 - DNA, 15 bp, Homo sapiens
gcatcacttactgta

SEQ ID NO: 53875 - DNA, 15 bp, Homo sapiens
catcacttactgtac

SEQ ID NO: 53876 - DNA, 15 bp, Homo sapiens
atcacttactgtacg

SEQ ID NO: 53877 - DNA, 15 bp, Homo sapiens
tcacttactgtacgc

SEQ ID NO: 53878 - DNA, 15 bp, Homo sapiens
cacttactgtacgcc

SEQ ID NO: 53879 - DNA, 15 bp, Homo sapiens
acttactgtacgcct

SEQ ID NO: 53880 - DNA, 15 bp, Homo sapiens
cttactgtacgcctt

SEQ ID NO: 53881 - DNA, 15 bp, Homo sapiens
ttactgtacgccttt

SEQ ID NO: 53882 - DNA, 15 bp, Homo sapiens
tactgtacgccttta

SEQ ID NO: 53883 - DNA, 15 bp, Homo sapiens
actgtacgcctttat

SEQ ID NO: 53884 - DNA, 15 bp, Homo sapiens
ctgtacgcctttatc

SEQ ID NO: 53885 - DNA, 15 bp, Homo sapiens
tgtacgcctttatct

SEQ ID NO: 53886 - DNA, 15 bp, Homo sapiens
gtacgcctttatcta

SEQ ID NO: 53887 - DNA, 15 bp, Homo sapiens
tacgcctttatctaa

SEQ ID NO: 53888 - DNA, 15 bp, Homo sapiens
acgcctttatctaaa

SEQ ID NO: 53889 - DNA, 15 bp, Homo sapiens
cgcctttatctaaat

SEQ ID NO: 53890 - DNA, 15 bp, Homo sapiens
gcctttatctaaatg

SEQ ID NO: 53891 - DNA, 15 bp, Homo sapiens
cctttatctaaatgg

SEQ ID NO: 53892 - DNA, 15 bp, Homo sapiens
ctttatctaaatggg

SEQ ID NO: 53893 - DNA, 15 bp, Homo sapiens
tttatctaaatgggt

SEQ ID NO: 53894 - DNA, 15 bp, Homo sapiens
ttatctaaatgggtc

SEQ ID NO: 53895 - DNA, 15 bp, Homo sapiens
tatctaaatgggtca

SEQ ID NO: 53896 - DNA, 15 bp, Homo sapiens
atctaaatgggtcat

SEQ ID NO: 53897 - DNA, 15 bp, Homo sapiens
tctaaatgggtcatg

SEQ ID NO: 53898 - DNA, 15 bp, Homo sapiens
ctaaatgggtcatgg

SEQ ID NO: 53899 - DNA, 15 bp, Homo sapiens
taaatgggtcatgga

SEQ ID NO: 53900 - DNA, 15 bp, Homo sapiens
aaatgggtcatggag

SEQ ID NO: 53901 - DNA, 15 bp, Homo sapiens
aatgggtcatggagc

SEQ ID NO: 53902 - DNA, 15 bp, Homo sapiens
atgggtcatggagcc

SEQ ID NO: 53903 - DNA, 15 bp, Homo sapiens
tgggtcatggagccc

SEQ ID NO: 53904 - DNA, 15 bp, Homo sapiens
gggtcatggagccca

SEQ ID NO: 53905 - DNA, 15 bp, Homo sapiens
ggtcatggagcccag

SEQ ID NO: 53906 - DNA, 15 bp, Homo sapiens
gtcatggagcccagt

SEQ ID NO: 53907 - DNA, 15 bp, Homo sapiens
tcatggagcccagtt

SEQ ID NO: 53908 - DNA, 15 bp, Homo sapiens
catggagcccagttc

SEQ ID NO: 53909 - DNA, 15 bp, Homo sapiens
atggagcccagttct

SEQ ID NO: 53910 - DNA, 15 bp, Homo sapiens
tggagcccagttctc

SEQ ID NO: 53911 - DNA, 15 bp, Homo sapiens
ggagcccagttctcg

SEQ ID NO: 53912 - DNA, 15 bp, Homo sapiens
gagcccagttctcgc

SEQ ID NO: 53913 - DNA, 15 bp, Homo sapiens
agcccagttctcgca

SEQ ID NO: 53914 - DNA, 15 bp, Homo sapiens
gcccagttctcgcag

SEQ ID NO: 53915 - DNA, 15 bp, Homo sapiens
cccagttctcgcagt

SEQ ID NO: 53916 - DNA, 15 bp, Homo sapiens
ccagttctcgcagtt

SEQ ID NO: 53917 - DNA, 15 bp, Homo sapiens
cagttctcgcagttt

SEQ ID NO: 53918 - DNA, 15 bp, Homo sapiens
agttctcgcagtttg

SEQ ID NO: 53919 - DNA, 15 bp, Homo sapiens
gttctcgcagtttgc

SEQ ID NO: 53920 - DNA, 15 bp, Homo sapiens
ttctcgcagtttgct

SEQ ID NO: 53921 - DNA, 15 bp, Homo sapiens
tctcgcagtttgctc

SEQ ID NO: 53922 - DNA, 15 bp, Homo sapiens
ctcgcagtttgctct

SEQ ID NO: 53923 - DNA, 15 bp, Homo sapiens
tcgcagtttgctctc

SEQ ID NO: 53924 - DNA, 15 bp, Homo sapiens
cgcagtttgctctcc

SEQ ID NO: 53925 - DNA, 15 bp, Homo sapiens
gcagtttgctctcca

SEQ ID NO: 53926 - DNA, 15 bp, Homo sapiens
cagtttgctctccag

SEQ ID NO: 53927 - DNA, 15 bp, Homo sapiens
agtttgctctccaga

SEQ ID NO: 53928 - DNA, 15 bp, Homo sapiens
gtttgctctccagat

SEQ ID NO: 53929 - DNA, 15 bp, Homo sapiens
tttgctctccagatt

SEQ ID NO: 53930 - DNA, 15 bp, Homo sapiens
ttgctctccagattg

SEQ ID NO: 53931 - DNA, 15 bp, Homo sapiens
tgctctccagattgc

SEQ ID NO: 53932 - DNA, 15 bp, Homo sapiens
gctctccagattgca

SEQ ID NO: 53933 - DNA, 15 bp, Homo sapiens
ctctccagattgcag

SEQ ID NO: 53934 - DNA, 15 bp, Homo sapiens
tctccagattgcagc

SEQ ID NO: 53935 - DNA, 15 bp, Homo sapiens
ctccagattgcagca

SEQ ID NO: 53936 - DNA, 15 bp, Homo sapiens
tccagattgcagcag

SEQ ID NO: 53937 - DNA, 15 bp, Homo sapiens
ccagattgcagcagc

SEQ ID NO: 53938 - DNA, 15 bp, Homo sapiens
cagattgcagcagct

SEQ ID NO: 53939 - DNA, 15 bp, Homo sapiens
agattgcagcagctt

SEQ ID NO: 53940 - DNA, 15 bp, Homo sapiens
gattgcagcagcttt

SEQ ID NO: 53941 - DNA, 15 bp, Homo sapiens
attgcagcagctttg

SEQ ID NO: 53942 - DNA, 15 bp, Homo sapiens
ttgcagcagctttgg

SEQ ID NO: 53943 - DNA, 15 bp, Homo sapiens
tgcagcagctttggt

SEQ ID NO: 53944 - DNA, 15 bp, Homo sapiens
gcagcagctttggtc

SEQ ID NO: 53945 - DNA, 15 bp, Homo sapiens
cagcagctttggtct

SEQ ID NO: 53946 - DNA, 15 bp, Homo sapiens
agcagctttggtctt

SEQ ID NO: 53947 - DNA, 15 bp, Homo sapiens
gcagctttggtcttt

SEQ ID NO: 53948 - DNA, 15 bp, Homo sapiens
cagctttggtctttg

SEQ ID NO: 53949 - DNA, 15 bp, Homo sapiens
agctttggtctttgt

SEQ ID NO: 53950 - DNA, 15 bp, Homo sapiens
gctttggtctttgtg

SEQ ID NO: 53951 - DNA, 15 bp, Homo sapiens
ctttggtctttgtgc

SEQ ID NO: 53952 - DNA, 15 bp, Homo sapiens
tttggtctttgtgcc

SEQ ID NO: 53953 - DNA, 15 bp, Homo sapiens
ttggtctttgtgcct

SEQ ID NO: 53954 - DNA, 15 bp, Homo sapiens
tggtctttgtgcctg

SEQ ID NO: 53955 - DNA, 15 bp, Homo sapiens
ggtctttgtgcctga

SEQ ID NO: 53956 - DNA, 15 bp, Homo sapiens
gtctttgtgcctgag

SEQ ID NO: 53957 - DNA, 15 bp, Homo sapiens
tctttgtgcctgagt

SEQ ID NO: 53958 - DNA, 15 bp, Homo sapiens
ctttgtgcctgagtt

SEQ ID NO: 53959 - DNA, 15 bp, Homo sapiens
tttgtgcctgagttg

SEQ ID NO: 53960 - DNA, 15 bp, Homo sapiens
ttgtgcctgagttgg

SEQ ID NO: 53961 - DNA, 15 bp, Homo sapiens
tgtgcctgagttgga

SEQ ID NO: 53962 - DNA, 15 bp, Homo sapiens
gtgcctgagttggaa

SEQ ID NO: 53963 - DNA, 15 bp, Homo sapiens
tgcctgagttggaag

SEQ ID NO: 53964 - DNA, 15 bp, Homo sapiens
gcctgagttggaaga

SEQ ID NO: 53965 - DNA, 15 bp, Homo sapiens
cctgagttggaagag

SEQ ID NO: 53966 - DNA, 15 bp, Homo sapiens
ctgagttggaagagg

SEQ ID NO: 53967 - DNA, 15 bp, Homo sapiens
tgagttggaagaggg

SEQ ID NO: 53968 - DNA, 15 bp, Homo sapiens
gagttggaagagggg

SEQ ID NO: 53969 - DNA, 15 bp, Homo sapiens
agttggaagagggga

SEQ ID NO: 53970 - DNA, 15 bp, Homo sapiens
gttggaagaggggag

SEQ ID NO: 53971 - DNA, 15 bp, Homo sapiens
ttggaagaggggagt

SEQ ID NO: 53972 - DNA, 15 bp, Homo sapiens
tggaagaggggagtg

SEQ ID NO: 53973 - DNA, 15 bp, Homo sapiens
ggaagaggggagtgg

SEQ ID NO: 53974 - DNA, 15 bp, Homo sapiens
gaagaggggagtggg

SEQ ID NO: 53975 - DNA, 15 bp, Homo sapiens
aagaggggagtgggc

SEQ ID NO: 53976 - DNA, 15 bp, Homo sapiens
agaggggagtgggca

SEQ ID NO: 53977 - DNA, 15 bp, Homo sapiens
gaggggagtgggcaa

SEQ ID NO: 53978 - DNA, 15 bp, Homo sapiens
aggggagtgggcaag

SEQ ID NO: 53979 - DNA, 15 bp, Homo sapiens
ggggagtgggcaaga

SEQ ID NO: 53980 - DNA, 15 bp, Homo sapiens
gggagtgggcaagac

SEQ ID NO: 53981 - DNA, 15 bp, Homo sapiens
ggagtgggcaagaca

SEQ ID NO: 53982 - DNA, 15 bp, Homo sapiens
gagtgggcaagacag

SEQ ID NO: 53983 - DNA, 15 bp, Homo sapiens
agtgggcaagacaga

SEQ ID NO: 53984 - DNA, 15 bp, Homo sapiens
gtgggcaagacagaa

SEQ ID NO: 53985 - DNA, 15 bp, Homo sapiens
tgggcaagacagaaa

SEQ ID NO: 53986 - DNA, 15 bp, Homo sapiens
gggcaagacagaaat

SEQ ID NO: 53987 - DNA, 15 bp, Homo sapiens
ggcaagacagaaatg

SEQ ID NO: 53988 - DNA, 15 bp, Homo sapiens
gcaagacagaaatgc

SEQ ID NO: 53989 - DNA, 15 bp, Homo sapiens
caagacagaaatgcc

SEQ ID NO: 53990 - DNA, 15 bp, Homo sapiens
aagacagaaatgcct

SEQ ID NO: 53991 - DNA, 15 bp, Homo sapiens
agacagaaatgcctt

SEQ ID NO: 53992 - DNA, 15 bp, Homo sapiens
gacagaaatgcctta

SEQ ID NO: 53993 - DNA, 15 bp, Homo sapiens
acagaaatgccttat

SEQ ID NO: 53994 - DNA, 15 bp, Homo sapiens
cagaaatgccttatg

SEQ ID NO: 53995 - DNA, 15 bp, Homo sapiens
agaaatgccttatgg

SEQ ID NO: 53996 - DNA, 15 bp, Homo sapiens
gaaatgccttatgga

SEQ ID NO: 53997 - DNA, 15 bp, Homo sapiens
aaatgccttatggaa

SEQ ID NO: 53998 - DNA, 15 bp, Homo sapiens
aatgccttatggaag

SEQ ID NO: 53999 - DNA, 15 bp, Homo sapiens
atgccttatggaagc

SEQ ID NO: 54000 - DNA, 15 bp, Homo sapiens
tgccttatggaagca

SEQ ID NO: 54001 - DNA, 15 bp, Homo sapiens
gccttatggaagcag

SEQ ID NO: 54002 - DNA, 15 bp, Homo sapiens
ccttatggaagcagt

SEQ ID NO: 54003 - DNA, 15 bp, Homo sapiens
cttatggaagcagtg

SEQ ID NO: 54004 - DNA, 15 bp, Homo sapiens
ttatggaagcagtgg

SEQ ID NO: 54005 - DNA, 15 bp, Homo sapiens
tatggaagcagtggt

SEQ ID NO: 54006 - DNA, 15 bp, Homo sapiens
atggaagcagtggtg

SEQ ID NO: 54007 - DNA, 15 bp, Homo sapiens
tggaagcagtggtgc

SEQ ID NO: 54008 - DNA, 15 bp, Homo sapiens
ggaagcagtggtgct

SEQ ID NO: 54009 - DNA, 15 bp, Homo sapiens
gaagcagtggtgctt

SEQ ID NO: 54010 - DNA, 15 bp, Homo sapiens
aagcagtggtgcttt

SEQ ID NO: 54011 - DNA, 15 bp, Homo sapiens
agcagtggtgctttg

SEQ ID NO: 54012 - DNA, 15 bp, Homo sapiens
gcagtggtgctttgg

SEQ ID NO: 54013 - DNA, 15 bp, Homo sapiens
cagtggtgctttggc

SEQ ID NO: 54014 - DNA, 15 bp, Homo sapiens
agtggtgctttggcc

SEQ ID NO: 54015 - DNA, 15 bp, Homo sapiens
gtggtgctttggccc

SEQ ID NO: 54016 - DNA, 15 bp, Homo sapiens
tggtgctttggccct

SEQ ID NO: 54017 - DNA, 15 bp, Homo sapiens
ggtgctttggccctc

SEQ ID NO: 54018 - DNA, 15 bp, Homo sapiens
gtgctttggccctcg

SEQ ID NO: 54019 - DNA, 15 bp, Homo sapiens
tgctttggccctcgg

SEQ ID NO: 54020 - DNA, 15 bp, Homo sapiens
gctttggccctcggg

SEQ ID NO: 54021 - DNA, 15 bp, Homo sapiens
ctttggccctcggga

SEQ ID NO: 54022 - DNA, 15 bp, Homo sapiens
tttggccctcgggag

SEQ ID NO: 54023 - DNA, 15 bp, Homo sapiens
ttggccctcgggagg

SEQ ID NO: 54024 - DNA, 15 bp, Homo sapiens
tggccctcgggaggg

SEQ ID NO: 54025 - DNA, 15 bp, Homo sapiens
ggccctcgggagggt

SEQ ID NO: 54026 - DNA, 15 bp, Homo sapiens
gccctcgggagggtt

SEQ ID NO: 54027 - DNA, 15 bp, Homo sapiens
ccctcgggagggttg

SEQ ID NO: 54028 - DNA, 15 bp, Homo sapiens
cctcgggagggttgt

SEQ ID NO: 54029 - DNA, 15 bp, Homo sapiens
ctcgggagggttgtc

SEQ ID NO: 54030 - DNA, 15 bp, Homo sapiens
tcgggagggttgtct

SEQ ID NO: 54031 - DNA, 15 bp, Homo sapiens
cgggagggttgtctg

SEQ ID NO: 54032 - DNA, 15 bp, Homo sapiens
gggagggttgtctgc

SEQ ID NO: 54033 - DNA, 15 bp, Homo sapiens
ggagggttgtctgca

SEQ ID NO: 54034 - DNA, 15 bp, Homo sapiens
gagggttgtctgcag

SEQ ID NO: 54035 - DNA, 15 bp, Homo sapiens
agggttgtctgcagc

SEQ ID NO: 54036 - DNA, 15 bp, Homo sapiens
gggttgtctgcagct

SEQ ID NO: 54037 - DNA, 15 bp, Homo sapiens
ggttgtctgcagctg

SEQ ID NO: 54038 - DNA, 15 bp, Homo sapiens
gttgtctgcagctgc

SEQ ID NO: 54039 - DNA, 15 bp, Homo sapiens
ttgtctgcagctgcc

SEQ ID NO: 54040 - DNA, 15 bp, Homo sapiens
tgtctgcagctgccc

SEQ ID NO: 54041 - DNA, 15 bp, Homo sapiens
gtctgcagctgcccc

SEQ ID NO: 54042 - DNA, 15 bp, Homo sapiens
tctgcagctgcccca

SEQ ID NO: 54043 - DNA, 15 bp, Homo sapiens
ctgcagctgccccaa

SEQ ID NO: 54044 - DNA, 15 bp, Homo sapiens
tgcagctgccccaat

SEQ ID NO: 54045 - DNA, 15 bp, Homo sapiens
gcagctgccccaatg

SEQ ID NO: 54046 - DNA, 15 bp, Homo sapiens
cagctgccccaatgt

SEQ ID NO: 54047 - DNA, 15 bp, Homo sapiens
agctgccccaatgtg

SEQ ID NO: 54048 - DNA, 15 bp, Homo sapiens
gctgccccaatgtgc

SEQ ID NO: 54049 - DNA, 15 bp, Homo sapiens
ctgccccaatgtgca

SEQ ID NO: 54050 - DNA, 15 bp, Homo sapiens
tgccccaatgtgcaa

SEQ ID NO: 54051 - DNA, 15 bp, Homo sapiens
gccccaatgtgcaaa

SEQ ID NO: 54052 - DNA, 15 bp, Homo sapiens
ccccaatgtgcaaag

SEQ ID NO: 54053 - DNA, 15 bp, Homo sapiens
cccaatgtgcaaaga

SEQ ID NO: 54054 - DNA, 15 bp, Homo sapiens
ccaatgtgcaaagaa

SEQ ID NO: 54055 - DNA, 15 bp, Homo sapiens
caatgtgcaaagaat

SEQ ID NO: 54056 - DNA, 15 bp, Homo sapiens
aatgtgcaaagaatc

SEQ ID NO: 54057 - DNA, 15 bp, Homo sapiens
atgtgcaaagaatcc

SEQ ID NO: 54058 - DNA, 15 bp, Homo sapiens
tgtgcaaagaatcct

SEQ ID NO: 54059 - DNA, 15 bp, Homo sapiens
gtgcaaagaatcctc

SEQ ID NO: 54060 - DNA, 15 bp, Homo sapiens
tgcaaagaatcctct

SEQ ID NO: 54061 - DNA, 15 bp, Homo sapiens
gcaaagaatcctctt

SEQ ID NO: 54062 - DNA, 15 bp, Homo sapiens
caaagaatcctcttt

SEQ ID NO: 54063 - DNA, 15 bp, Homo sapiens
aaagaatcctcttta

SEQ ID NO: 54064 - DNA, 15 bp, Homo sapiens
aagaatcctctttaa

SEQ ID NO: 54065 - DNA, 15 bp, Homo sapiens
agaatcctctttaac

SEQ ID NO: 54066 - DNA, 15 bp, Homo sapiens
gaatcctctttaacg

SEQ ID NO: 54067 - DNA, 15 bp, Homo sapiens
aatcctctttaacgt

SEQ ID NO: 54068 - DNA, 15 bp, Homo sapiens
atcctctttaacgtg

SEQ ID NO: 54069 - DNA, 15 bp, Homo sapiens
tcctctttaacgtga

SEQ ID NO: 54070 - DNA, 15 bp, Homo sapiens
cctctttaacgtgag

SEQ ID NO: 54071 - DNA, 15 bp, Homo sapiens
ctctttaacgtgaga

SEQ ID NO: 54072 - DNA, 15 bp, Homo sapiens
tctttaacgtgagac

SEQ ID NO: 54073 - DNA, 15 bp, Homo sapiens
ctttaacgtgagact

SEQ ID NO: 54074 - DNA, 15 bp, Homo sapiens
tttaacgtgagactg

SEQ ID NO: 54075 - DNA, 15 bp, Homo sapiens
ttaacgtgagactga

SEQ ID NO: 54076 - DNA, 15 bp, Homo sapiens
taacgtgagactgag

SEQ ID NO: 54077 - DNA, 15 bp, Homo sapiens
aacgtgagactgagc

SEQ ID NO: 54078 - DNA, 15 bp, Homo sapiens
acgtgagactgagct

SEQ ID NO: 54079 - DNA, 15 bp, Homo sapiens
cgtgagactgagcta

SEQ ID NO: 54080 - DNA, 15 bp, Homo sapiens
gtgagactgagctaa

SEQ ID NO: 54081 - DNA, 15 bp, Homo sapiens
tgagactgagctaac

SEQ ID NO: 54082 - DNA, 15 bp, Homo sapiens
gagactgagctaaca

SEQ ID NO: 54083 - DNA, 15 bp, Homo sapiens
agactgagctaacat

SEQ ID NO: 54084 - DNA, 15 bp, Homo sapiens
gactgagctaacatt

SEQ ID NO: 54085 - DNA, 15 bp, Homo sapiens
actgagctaacatta

SEQ ID NO: 54086 - DNA, 15 bp, Homo sapiens
ctgagctaacattaa

SEQ ID NO: 54087 - DNA, 15 bp, Homo sapiens
tgagctaacattaac

SEQ ID NO: 54088 - DNA, 15 bp, Homo sapiens
gagctaacattaacc

SEQ ID NO: 54089 - DNA, 15 bp, Homo sapiens
agctaacattaacca

SEQ ID NO: 54090 - DNA, 15 bp, Homo sapiens
gctaacattaaccag

SEQ ID NO: 54091 - DNA, 15 bp, Homo sapiens
ctaacattaaccagg

SEQ ID NO: 54092 - DNA, 15 bp, Homo sapiens
taacattaaccaggt

SEQ ID NO: 54093 - DNA, 15 bp, Homo sapiens
aacattaaccaggta

SEQ ID NO: 54094 - DNA, 15 bp, Homo sapiens
acattaaccaggtag

SEQ ID NO: 54095 - DNA, 15 bp, Homo sapiens
cattaaccaggtagt

SEQ ID NO: 54096 - DNA, 15 bp, Homo sapiens
attaaccaggtagtc

SEQ ID NO: 54097 - DNA, 15 bp, Homo sapiens
ttaaccaggtagtca

SEQ ID NO: 54098 - DNA, 15 bp, Homo sapiens
taaccaggtagtcac

SEQ ID NO: 54099 - DNA, 15 bp, Homo sapiens
aaccaggtagtcaca

SEQ ID NO: 54100 - DNA, 15 bp, Homo sapiens
accaggtagtcacat

SEQ ID NO: 54101 - DNA, 15 bp, Homo sapiens
ccaggtagtcacatg

SEQ ID NO: 54102 - DNA, 15 bp, Homo sapiens
caggtagtcacatga

SEQ ID NO: 54103 - DNA, 15 bp, Homo sapiens
aggtagtcacatgaa

SEQ ID NO: 54104 - DNA, 15 bp, Homo sapiens
ggtagtcacatgaaa

SEQ ID NO: 54105 - DNA, 15 bp, Homo sapiens
gtagtcacatgaaat

SEQ ID NO: 54106 - DNA, 15 bp, Homo sapiens
tagtcacatgaaatt

SEQ ID NO: 54107 - DNA, 15 bp, Homo sapiens
agtcacatgaaattc

SEQ ID NO: 54108 - DNA, 15 bp, Homo sapiens
gtcacatgaaattct

SEQ ID NO: 54109 - DNA, 15 bp, Homo sapiens
tcacatgaaattctt

SEQ ID NO: 54110 - DNA, 15 bp, Homo sapiens
cacatgaaattcttg

SEQ ID NO: 54111 - DNA, 15 bp, Homo sapiens
acatgaaattcttgc

SEQ ID NO: 54112 - DNA, 15 bp, Homo sapiens
catgaaattcttgcc

SEQ ID NO: 54113 - DNA, 15 bp, Homo sapiens
atgaaattcttgccc

SEQ ID NO: 54114 - DNA, 15 bp, Homo sapiens
tgaaattcttgccct

SEQ ID NO: 54115 - DNA, 15 bp, Homo sapiens
gaaattcttgccctc

SEQ ID NO: 54116 - DNA, 15 bp, Homo sapiens
aaattcttgccctcc

SEQ ID NO: 54117 - DNA, 15 bp, Homo sapiens
aattcttgccctcca

SEQ ID NO: 54118 - DNA, 15 bp, Homo sapiens
attcttgccctccaa

SEQ ID NO: 54119 - DNA, 15 bp, Homo sapiens
ttcttgccctccaaa

SEQ ID NO: 54120 - DNA, 15 bp, Homo sapiens
tcttgccctccaaaa

SEQ ID NO: 54121 - DNA, 15 bp, Homo sapiens
cttgccctccaaaag

SEQ ID NO: 54122 - DNA, 15 bp, Homo sapiens
ttgccctccaaaagt

SEQ ID NO: 54123 - DNA, 15 bp, Homo sapiens
tgccctccaaaagtt

SEQ ID NO: 54124 - DNA, 15 bp, Homo sapiens
gccctccaaaagttg

SEQ ID NO: 54125 - DNA, 15 bp, Homo sapiens
ccctccaaaagttgg

SEQ ID NO: 54126 - DNA, 15 bp, Homo sapiens
cctccaaaagttggc

SEQ ID NO: 54127 - DNA, 15 bp, Homo sapiens
ctccaaaagttggct

SEQ ID NO: 54128 - DNA, 15 bp, Homo sapiens
tccaaaagttggctt

SEQ ID NO: 54129 - DNA, 15 bp, Homo sapiens
ccaaaagttggcttt

SEQ ID NO: 54130 - DNA, 15 bp, Homo sapiens
caaaagttggcttta

SEQ ID NO: 54131 - DNA, 15 bp, Homo sapiens
aaaagttggctttat

SEQ ID NO: 54132 - DNA, 15 bp, Homo sapiens
aaagttggctttatc

SEQ ID NO: 54133 - DNA, 15 bp, Homo sapiens
aagttggctttatct

SEQ ID NO: 54134 - DNA, 15 bp, Homo sapiens
agttggctttatctc

SEQ ID NO: 54135 - DNA, 15 bp, Homo sapiens
gttggctttatctca

SEQ ID NO: 54136 - DNA, 15 bp, Homo sapiens
ttggctttatctcag

SEQ ID NO: 54137 - DNA, 15 bp, Homo sapiens
tggctttatctcagt

SEQ ID NO: 54138 - DNA, 15 bp, Homo sapiens
ggctttatctcagtc

SEQ ID NO: 54139 - DNA, 15 bp, Homo sapiens
gctttatctcagtca

SEQ ID NO: 54140 - DNA, 15 bp, Homo sapiens
ctttatctcagtcag

SEQ ID NO: 54141 - DNA, 15 bp, Homo sapiens
tttatctcagtcagc

SEQ ID NO: 54142 - DNA, 15 bp, Homo sapiens
ttatctcagtcagct

SEQ ID NO: 54143 - DNA, 15 bp, Homo sapiens
tatctcagtcagctt

SEQ ID NO: 54144 - DNA, 15 bp, Homo sapiens
atctcagtcagctta

SEQ ID NO: 54145 - DNA, 15 bp, Homo sapiens
tctcagtcagcttaa

SEQ ID NO: 54146 - DNA, 15 bp, Homo sapiens
ctcagtcagcttaat

SEQ ID NO: 54147 - DNA, 15 bp, Homo sapiens
tcagtcagcttaata

SEQ ID NO: 54148 - DNA, 15 bp, Homo sapiens
cagtcagcttaataa

SEQ ID NO: 54149 - DNA, 15 bp, Homo sapiens
agtcagcttaataat

SEQ ID NO: 54150 - DNA, 15 bp, Homo sapiens
gtcagcttaataatt

SEQ ID NO: 54151 - DNA, 15 bp, Homo sapiens
tcagcttaataattt

SEQ ID NO: 54152 - DNA, 15 bp, Homo sapiens
cagcttaataatttt

SEQ ID NO: 54153 - DNA, 15 bp, Homo sapiens
agcttaataattttt

SEQ ID NO: 54154 - DNA, 15 bp, Homo sapiens
gcttaataatttttt

SEQ ID NO: 54155 - DNA, 15 bp, Homo sapiens
cttaataattttttt

SEQ ID NO: 54156 - DNA, 15 bp, Homo sapiens
ttaataattttttta

SEQ ID NO: 54157 - DNA, 15 bp, Homo sapiens
taataatttttttat

SEQ ID NO: 54158 - DNA, 15 bp, Homo sapiens
aataatttttttatt

SEQ ID NO: 54159 - DNA, 15 bp, Homo sapiens
ataatttttttattt

SEQ ID NO: 54160 - DNA, 15 bp, Homo sapiens
taatttttttatttt

SEQ ID NO: 54161 - DNA, 15 bp, Homo sapiens
aatttttttattttt

SEQ ID NO: 54162 - DNA, 15 bp, Homo sapiens
atttttttattttta

SEQ ID NO: 54163 - DNA, 15 bp, Homo sapiens
tttttttatttttat

SEQ ID NO: 54164 - DNA, 15 bp, Homo sapiens
ttttttatttttatt

SEQ ID NO: 54165 - DNA, 15 bp, Homo sapiens
tttttatttttattt

SEQ ID NO: 54166 - DNA, 15 bp, Homo sapiens
ttttatttttattta

SEQ ID NO: 54167 - DNA, 15 bp, Homo sapiens
tttatttttatttat

SEQ ID NO: 54168 - DNA, 15 bp, Homo sapiens
ttatttttatttatt

SEQ ID NO: 54169 - DNA, 15 bp, Homo sapiens
tatttttatttattt

SEQ ID NO: 54170 - DNA, 15 bp, Homo sapiens
atttttatttatttt

SEQ ID NO: 54171 - DNA, 15 bp, Homo sapiens
tttttatttattttt

SEQ ID NO: 54172 - DNA, 15 bp, Homo sapiens
ttttatttatttttt

SEQ ID NO: 54173 - DNA, 15 bp, Homo sapiens
tttatttattttttt

SEQ ID NO: 54174 - DNA, 15 bp, Homo sapiens
ttatttatttttttg

SEQ ID NO: 54175 - DNA, 15 bp, Homo sapiens
tatttatttttttga

SEQ ID NO: 54176 - DNA, 15 bp, Homo sapiens
atttatttttttgag

SEQ ID NO: 54177 - DNA, 15 bp, Homo sapiens
tttatttttttgaga

SEQ ID NO: 54178 - DNA, 15 bp, Homo sapiens
ttatttttttgagac

SEQ ID NO: 54179 - DNA, 15 bp, Homo sapiens
tatttttttgagaca

SEQ ID NO: 54180 - DNA, 15 bp, Homo sapiens
atttttttgagacag

SEQ ID NO: 54181 - DNA, 15 bp, Homo sapiens
tttttttgagacagt

SEQ ID NO: 54182 - DNA, 15 bp, Homo sapiens
ttttttgagacagtc

SEQ ID NO: 54183 - DNA, 15 bp, Homo sapiens
tttttgagacagtct

SEQ ID NO: 54184 - DNA, 15 bp, Homo sapiens
ttttgagacagtctc

SEQ ID NO: 54185 - DNA, 15 bp, Homo sapiens
tttgagacagtctcg

SEQ ID NO: 54186 - DNA, 15 bp, Homo sapiens
ttgagacagtctcgc

SEQ ID NO: 54187 - DNA, 15 bp, Homo sapiens
tgagacagtctcgct

SEQ ID NO: 54188 - DNA, 15 bp, Homo sapiens
gagacagtctcgctg

SEQ ID NO: 54189 - DNA, 15 bp, Homo sapiens
agacagtctcgctgt

SEQ ID NO: 54190 - DNA, 15 bp, Homo sapiens
gacagtctcgctgtc

SEQ ID NO: 54191 - DNA, 15 bp, Homo sapiens
acagtctcgctgtcg

SEQ ID NO: 54192 - DNA, 15 bp, Homo sapiens
cagtctcgctgtcgc

SEQ ID NO: 54193 - DNA, 15 bp, Homo sapiens
agtctcgctgtcgcc

SEQ ID NO: 54194 - DNA, 15 bp, Homo sapiens
gtctcgctgtcgccc

SEQ ID NO: 54195 - DNA, 15 bp, Homo sapiens
tctcgctgtcgccca

SEQ ID NO: 54196 - DNA, 15 bp, Homo sapiens
ctcgctgtcgcccag

SEQ ID NO: 54197 - DNA, 15 bp, Homo sapiens
tcgctgtcgcccagg

SEQ ID NO: 54198 - DNA, 15 bp, Homo sapiens
cgctgtcgcccaggc

SEQ ID NO: 54199 - DNA, 15 bp, Homo sapiens
gctgtcgcccaggct

SEQ ID NO: 54200 - DNA, 15 bp, Homo sapiens
ctgtcgcccaggctt

SEQ ID NO: 54201 - DNA, 15 bp, Homo sapiens
tgtcgcccaggcttc

SEQ ID NO: 54202 - DNA, 15 bp, Homo sapiens
gtcgcccaggcttcg

SEQ ID NO: 54203 - DNA, 15 bp, Homo sapiens
tcgcccaggcttcgg

SEQ ID NO: 54204 - DNA, 15 bp, Homo sapiens
cgcccaggcttcggg

SEQ ID NO: 54205 - DNA, 15 bp, Homo sapiens
gcccaggcttcgggc

SEQ ID NO: 54206 - DNA, 15 bp, Homo sapiens
cccaggcttcgggca

SEQ ID NO: 54207 - DNA, 15 bp, Homo sapiens
ccaggcttcgggcag

SEQ ID NO: 54208 - DNA, 15 bp, Homo sapiens
caggcttcgggcagt

SEQ ID NO: 54209 - DNA, 15 bp, Homo sapiens
aggcttcgggcagtg

SEQ ID NO: 54210 - DNA, 15 bp, Homo sapiens
ggcttcgggcagtgg

SEQ ID NO: 54211 - DNA, 15 bp, Homo sapiens
gcttcgggcagtggc

SEQ ID NO: 54212 - DNA, 15 bp, Homo sapiens
cttcgggcagtggca

SEQ ID NO: 54213 - DNA, 15 bp, Homo sapiens
ttcgggcagtggcac

SEQ ID NO: 54214 - DNA, 15 bp, Homo sapiens
tcgggcagtggcacg

SEQ ID NO: 54215 - DNA, 15 bp, Homo sapiens
cgggcagtggcacga

SEQ ID NO: 54216 - DNA, 15 bp, Homo sapiens
gggcagtggcacgat

SEQ ID NO: 54217 - DNA, 15 bp, Homo sapiens
ggcagtggcacgatc

SEQ ID NO: 54218 - DNA, 15 bp, Homo sapiens
agtggcacgatctca

SEQ ID NO: 54219 - DNA, 15 bp, Homo sapiens
gtggcacgatctcag

SEQ ID NO: 54220 - DNA, 15 bp, Homo sapiens
tggcacgatctcagc

SEQ ID NO: 54221 - DNA, 15 bp, Homo sapiens
ggcacgatctcagct

SEQ ID NO: 54222 - DNA, 15 bp, Homo sapiens
gcacgatctcagctc

SEQ ID NO: 54223 - DNA, 15 bp, Homo sapiens
cacgatctcagctca

SEQ ID NO: 54224 - DNA, 15 bp, Homo sapiens
acgatctcagctcac

SEQ ID NO: 54225 - DNA, 15 bp, Homo sapiens
atctcagctcactgt

SEQ ID NO: 54226 - DNA, 15 bp, Homo sapiens
tctcagctcactgtc

SEQ ID NO: 54227 - DNA, 15 bp, Homo sapiens
ctcagctcactgtcc

SEQ ID NO: 54228 - DNA, 15 bp, Homo sapiens
tcagctcactgtccc

SEQ ID NO: 54229 - DNA, 15 bp, Homo sapiens
cagctcactgtcccc

SEQ ID NO: 54230 - DNA, 15 bp, Homo sapiens
agctcactgtcccct

SEQ ID NO: 54231 - DNA, 15 bp, Homo sapiens
gctcactgtcccctc

SEQ ID NO: 54232 - DNA, 15 bp, Homo sapiens
ctcactgtcccctcc

SEQ ID NO: 54233 - DNA, 15 bp, Homo sapiens
tcactgtcccctcca

SEQ ID NO: 54234 - DNA, 15 bp, Homo sapiens
cactgtcccctccac

SEQ ID NO: 54235 - DNA, 15 bp, Homo sapiens
actgtcccctccacc

SEQ ID NO: 54236 - DNA, 15 bp, Homo sapiens
ctgtcccctccacct

SEQ ID NO: 54237 - DNA, 15 bp, Homo sapiens
tgtcccctccacctc

SEQ ID NO: 54238 - DNA, 15 bp, Homo sapiens
gtcccctccacctcc

SEQ ID NO: 54239 - DNA, 15 bp, Homo sapiens
tcccctccacctcct

SEQ ID NO: 54240 - DNA, 15 bp, Homo sapiens
cccctccacctcctg

SEQ ID NO: 54241 - DNA, 15 bp, Homo sapiens
ccctccacctcctgg

SEQ ID NO: 54242 - DNA, 15 bp, Homo sapiens
cctgggttcaagcct

SEQ ID NO: 54243 - DNA, 15 bp, Homo sapiens
ctgggttcaagcctc

SEQ ID NO: 54244 - DNA, 15 bp, Homo sapiens
tgggttcaagcctcc

SEQ ID NO: 54245 - DNA, 15 bp, Homo sapiens
gggttcaagcctccc

SEQ ID NO: 54246 - DNA, 15 bp, Homo sapiens
ggttcaagcctcccg

SEQ ID NO: 54247 - DNA, 15 bp, Homo sapiens
gttcaagcctcccga

SEQ ID NO: 54248 - DNA, 15 bp, Homo sapiens
ttcaagcctcccgaa

SEQ ID NO: 54249 - DNA, 15 bp, Homo sapiens
tcaagcctcccgaac

SEQ ID NO: 54250 - DNA, 15 bp, Homo sapiens
caagcctcccgaaca

SEQ ID NO: 54251 - DNA, 15 bp, Homo sapiens
aagcctcccgaacag

SEQ ID NO: 54252 - DNA, 15 bp, Homo sapiens
agcctcccgaacagc

SEQ ID NO: 54253 - DNA, 15 bp, Homo sapiens
gcctcccgaacagct

SEQ ID NO: 54254 - DNA, 15 bp, Homo sapiens
cctcccgaacagctg

SEQ ID NO: 54255 - DNA, 15 bp, Homo sapiens
ctcccgaacagctgg

SEQ ID NO: 54256 - DNA, 15 bp, Homo sapiens
tcccgaacagctggg

SEQ ID NO: 54257 - DNA, 15 bp, Homo sapiens
cccgaacagctggga

SEQ ID NO: 54258 - DNA, 15 bp, Homo sapiens
ccgaacagctgggat

SEQ ID NO: 54259 - DNA, 15 bp, Homo sapiens
cgaacagctgggatt

SEQ ID NO: 54260 - DNA, 15 bp, Homo sapiens
gaacagctgggatta

SEQ ID NO: 54261 - DNA, 15 bp, Homo sapiens
aacagctgggattac

SEQ ID NO: 54262 - DNA, 15 bp, Homo sapiens
acagctgggattaca

SEQ ID NO: 54263 - DNA, 15 bp, Homo sapiens
cagctgggattacag

SEQ ID NO: 54264 - DNA, 15 bp, Homo sapiens
acaggcatgcgccac

SEQ ID NO: 54265 - DNA, 15 bp, Homo sapiens
caggcatgcgccacc

SEQ ID NO: 54266 - DNA, 15 bp, Homo sapiens
aggcatgcgccacca

SEQ ID NO: 54267 - DNA, 15 bp, Homo sapiens
ggcatgcgccaccac

SEQ ID NO: 54268 - DNA, 15 bp, Homo sapiens
gcatgcgccaccact

SEQ ID NO: 54269 - DNA, 15 bp, Homo sapiens
catgcgccaccactc

SEQ ID NO: 54270 - DNA, 15 bp, Homo sapiens
atgcgccaccactcc

SEQ ID NO: 54271 - DNA, 15 bp, Homo sapiens
tgcgccaccactccc

SEQ ID NO: 54272 - DNA, 15 bp, Homo sapiens
gcgccaccactccct

SEQ ID NO: 54273 - DNA, 15 bp, Homo sapiens
cgccaccactccctg

SEQ ID NO: 54274 - DNA, 15 bp, Homo sapiens
gccaccactccctgc

SEQ ID NO: 54275 - DNA, 15 bp, Homo sapiens
ccaccactccctgcc

SEQ ID NO: 54276 - DNA, 15 bp, Homo sapiens
caccactccctgcca

SEQ ID NO: 54277 - DNA, 15 bp, Homo sapiens
accactccctgccat

SEQ ID NO: 54278 - DNA, 15 bp, Homo sapiens
ccactccctgccatt

SEQ ID NO: 54279 - DNA, 15 bp, Homo sapiens
cactccctgccattt

SEQ ID NO: 54280 - DNA, 15 bp, Homo sapiens
actccctgccatttt

SEQ ID NO: 54281 - DNA, 15 bp, Homo sapiens
ctccctgccattttt

SEQ ID NO: 54282 - DNA, 15 bp, Homo sapiens
tccctgccatttttt

SEQ ID NO: 54283 - DNA, 15 bp, Homo sapiens
ccctgccattttttt

SEQ ID NO: 54284 - DNA, 15 bp, Homo sapiens
cctgccatttttttg

SEQ ID NO: 54285 - DNA, 15 bp, Homo sapiens
ctgccatttttttgt

SEQ ID NO: 54286 - DNA, 15 bp, Homo sapiens
tgccatttttttgtg

SEQ ID NO: 54287 - DNA, 15 bp, Homo sapiens
gccatttttttgtgt

SEQ ID NO: 54288 - DNA, 15 bp, Homo sapiens
ccatttttttgtgtt

SEQ ID NO: 54289 - DNA, 15 bp, Homo sapiens
catttttttgtgttt

SEQ ID NO: 54290 - DNA, 15 bp, Homo sapiens
atttttttgtgtttt

SEQ ID NO: 54291 - DNA, 15 bp, Homo sapiens
tttttttgtgtttta

SEQ ID NO: 54292 - DNA, 15 bp, Homo sapiens
ttttttgtgttttag

SEQ ID NO: 54293 - DNA, 15 bp, Homo sapiens
tttttgtgttttagt

SEQ ID NO: 54294 - DNA, 15 bp, Homo sapiens
ttttgtgttttagta

SEQ ID NO: 54295 - DNA, 15 bp, Homo sapiens
tttgtgttttagtag

SEQ ID NO: 54296 - DNA, 15 bp, Homo sapiens
ttgtgttttagtaga

SEQ ID NO: 54297 - DNA, 15 bp, Homo sapiens
tgtgttttagtagaa

SEQ ID NO: 54298 - DNA, 15 bp, Homo sapiens
gtgttttagtagaaa

SEQ ID NO: 54299 - DNA, 15 bp, Homo sapiens
tgttttagtagaaat

SEQ ID NO: 54300 - DNA, 15 bp, Homo sapiens
gttttagtagaaatg

SEQ ID NO: 54301 - DNA, 15 bp, Homo sapiens
ttttagtagaaatga

SEQ ID NO: 54302 - DNA, 15 bp, Homo sapiens
tttagtagaaatgag

SEQ ID NO: 54303 - DNA, 15 bp, Homo sapiens
ttagtagaaatgagg

SEQ ID NO: 54304 - DNA, 15 bp, Homo sapiens
tagtagaaatgaggt

SEQ ID NO: 54305 - DNA, 15 bp, Homo sapiens
agtagaaatgaggtt

SEQ ID NO: 54306 - DNA, 15 bp, Homo sapiens
gtagaaatgaggttt

SEQ ID NO: 54307 - DNA, 15 bp, Homo sapiens
tagaaatgaggtttc

SEQ ID NO: 54308 - DNA, 15 bp, Homo sapiens
agaaatgaggtttca

SEQ ID NO: 54309 - DNA, 15 bp, Homo sapiens
gaaatgaggtttcac

SEQ ID NO: 54310 - DNA, 15 bp, Homo sapiens
aaatgaggtttcacc

SEQ ID NO: 54311 - DNA, 15 bp, Homo sapiens
aatgaggtttcacca

SEQ ID NO: 54312 - DNA, 15 bp, Homo sapiens
atgaggtttcaccat

SEQ ID NO: 54313 - DNA, 15 bp, Homo sapiens
tgaggtttcaccatg

SEQ ID NO: 54314 - DNA, 15 bp, Homo sapiens
gaggtttcaccatgt

SEQ ID NO: 54315 - DNA, 15 bp, Homo sapiens
aggtttcaccatgtt

SEQ ID NO: 54316 - DNA, 15 bp, Homo sapiens
gtttcaccatgttgc

SEQ ID NO: 54317 - DNA, 15 bp, Homo sapiens
tttcaccatgttgcc

SEQ ID NO: 54318 - DNA, 15 bp, Homo sapiens
ttcaccatgttgccc

SEQ ID NO: 54319 - DNA, 15 bp, Homo sapiens
ccaggctggtctctt

SEQ ID NO: 54320 - DNA, 15 bp, Homo sapiens
caggctggtctctta

SEQ ID NO: 54321 - DNA, 15 bp, Homo sapiens
aggctggtctcttaa

SEQ ID NO: 54322 - DNA, 15 bp, Homo sapiens
ggctggtctcttaac

SEQ ID NO: 54323 - DNA, 15 bp, Homo sapiens
gctggtctcttaact

SEQ ID NO: 54324 - DNA, 15 bp, Homo sapiens
ctggtctcttaactg

SEQ ID NO: 54325 - DNA, 15 bp, Homo sapiens
tggtctcttaactgc

SEQ ID NO: 54326 - DNA, 15 bp, Homo sapiens
ggtctcttaactgct

SEQ ID NO: 54327 - DNA, 15 bp, Homo sapiens
gtctcttaactgctg

SEQ ID NO: 54328 - DNA, 15 bp, Homo sapiens
tctcttaactgctga

SEQ ID NO: 54329 - DNA, 15 bp, Homo sapiens
ctcttaactgctgag

SEQ ID NO: 54330 - DNA, 15 bp, Homo sapiens
tcttaactgctgagc

SEQ ID NO: 54331 - DNA, 15 bp, Homo sapiens
cttaactgctgagct

SEQ ID NO: 54332 - DNA, 15 bp, Homo sapiens
ttaactgctgagctc

SEQ ID NO: 54333 - DNA, 15 bp, Homo sapiens
taactgctgagctca

SEQ ID NO: 54334 - DNA, 15 bp, Homo sapiens
aactgctgagctcag

SEQ ID NO: 54335 - DNA, 15 bp, Homo sapiens
actgctgagctcagc

SEQ ID NO: 54336 - DNA, 15 bp, Homo sapiens
ctgctgagctcagcc

SEQ ID NO: 54337 - DNA, 15 bp, Homo sapiens
tgctgagctcagcca

SEQ ID NO: 54338 - DNA, 15 bp, Homo sapiens
gctgagctcagccag

SEQ ID NO: 54339 - DNA, 15 bp, Homo sapiens
ctgagctcagccagt

SEQ ID NO: 54340 - DNA, 15 bp, Homo sapiens
tgagctcagccagtc

SEQ ID NO: 54341 - DNA, 15 bp, Homo sapiens
gagctcagccagtct

SEQ ID NO: 54342 - DNA, 15 bp, Homo sapiens
agctcagccagtctg

SEQ ID NO: 54343 - DNA, 15 bp, Homo sapiens
gctcagccagtctgc

SEQ ID NO: 54344 - DNA, 15 bp, Homo sapiens
ctcagccagtctgcc

SEQ ID NO: 54345 - DNA, 15 bp, Homo sapiens
tcagccagtctgccc

SEQ ID NO: 54346 - DNA, 15 bp, Homo sapiens
cagccagtctgccca

SEQ ID NO: 54347 - DNA, 15 bp, Homo sapiens
agccagtctgcccac

SEQ ID NO: 54348 - DNA, 15 bp, Homo sapiens
gccagtctgcccacc

SEQ ID NO: 54349 - DNA, 15 bp, Homo sapiens
ccagtctgcccacct

SEQ ID NO: 54350 - DNA, 15 bp, Homo sapiens
cagtctgcccacctt

SEQ ID NO: 54351 - DNA, 15 bp, Homo sapiens
agtctgcccaccttg

SEQ ID NO: 54352 - DNA, 15 bp, Homo sapiens
gtctgcccaccttgg

SEQ ID NO: 54353 - DNA, 15 bp, Homo sapiens
tctgcccaccttggc

SEQ ID NO: 54354 - DNA, 15 bp, Homo sapiens
ctgcccaccttggct

SEQ ID NO: 54355 - DNA, 15 bp, Homo sapiens
tgcccaccttggctt

SEQ ID NO: 54356 - DNA, 15 bp, Homo sapiens
gcccaccttggcttc

SEQ ID NO: 54357 - DNA, 15 bp, Homo sapiens
cccaccttggcttcc

SEQ ID NO: 54358 - DNA, 15 bp, Homo sapiens
ccaccttggcttccc

SEQ ID NO: 54359 - DNA, 15 bp, Homo sapiens
caccttggcttccca

SEQ ID NO: 54360 - DNA, 15 bp, Homo sapiens
accttggcttcccaa

SEQ ID NO: 54361 - DNA, 15 bp, Homo sapiens
ccttggcttcccaaa

SEQ ID NO: 54362 - DNA, 15 bp, Homo sapiens
cttggcttcccaaag

SEQ ID NO: 54363 - DNA, 15 bp, Homo sapiens
ttggcttcccaaagt

SEQ ID NO: 54364 - DNA, 15 bp, Homo sapiens
tggcttcccaaagtg

SEQ ID NO: 54365 - DNA, 15 bp, Homo sapiens
ggcttcccaaagtgc

SEQ ID NO: 54366 - DNA, 15 bp, Homo sapiens
ggcataagccaccgc

SEQ ID NO: 54367 - DNA, 15 bp, Homo sapiens
gcataagccaccgca

SEQ ID NO: 54368 - DNA, 15 bp, Homo sapiens
cataagccaccgcac

SEQ ID NO: 54369 - DNA, 15 bp, Homo sapiens
ataagccaccgcacc

SEQ ID NO: 54370 - DNA, 15 bp, Homo sapiens
taagccaccgcacct

SEQ ID NO: 54371 - DNA, 15 bp, Homo sapiens
aagccaccgcacctg

SEQ ID NO: 54372 - DNA, 15 bp, Homo sapiens
agccaccgcacctgg

SEQ ID NO: 54373 - DNA, 15 bp, Homo sapiens
gccaccgcacctggc

SEQ ID NO: 54374 - DNA, 15 bp, Homo sapiens
ccaccgcacctggcc

SEQ ID NO: 54375 - DNA, 15 bp, Homo sapiens
caccgcacctggcct

SEQ ID NO: 54376 - DNA, 15 bp, Homo sapiens
accgcacctggcctc

SEQ ID NO: 54377 - DNA, 15 bp, Homo sapiens
ccgcacctggcctca

SEQ ID NO: 54378 - DNA, 15 bp, Homo sapiens
cgcacctggcctcag

SEQ ID NO: 54379 - DNA, 15 bp, Homo sapiens
gcacctggcctcagt

SEQ ID NO: 54380 - DNA, 15 bp, Homo sapiens
cacctggcctcagtc

SEQ ID NO: 54381 - DNA, 15 bp, Homo sapiens
acctggcctcagtca

SEQ ID NO: 54382 - DNA, 15 bp, Homo sapiens
cctggcctcagtcat

SEQ ID NO: 54383 - DNA, 15 bp, Homo sapiens
ctggcctcagtcatc

SEQ ID NO: 54384 - DNA, 15 bp, Homo sapiens
tggcctcagtcatct

SEQ ID NO: 54385 - DNA, 15 bp, Homo sapiens
ggcctcagtcatctg

SEQ ID NO: 54386 - DNA, 15 bp, Homo sapiens
gcctcagtcatctga

SEQ ID NO: 54387 - DNA, 15 bp, Homo sapiens
cctcagtcatctgaa

SEQ ID NO: 54388 - DNA, 15 bp, Homo sapiens
ctcagtcatctgaat

SEQ ID NO: 54389 - DNA, 15 bp, Homo sapiens
tcagtcatctgaatt

SEQ ID NO: 54390 - DNA, 15 bp, Homo sapiens
cagtcatctgaattt

SEQ ID NO: 54391 - DNA, 15 bp, Homo sapiens
agtcatctgaattta

SEQ ID NO: 54392 - DNA, 15 bp, Homo sapiens
gtcatctgaatttaa

SEQ ID NO: 54393 - DNA, 15 bp, Homo sapiens
tcatctgaatttaag

SEQ ID NO: 54394 - DNA, 15 bp, Homo sapiens
catctgaatttaagt

SEQ ID NO: 54395 - DNA, 15 bp, Homo sapiens
atctgaatttaagta

SEQ ID NO: 54396 - DNA, 15 bp, Homo sapiens
tctgaatttaagtaa

SEQ ID NO: 54397 - DNA, 15 bp, Homo sapiens
ctgaatttaagtaat

SEQ ID NO: 54398 - DNA, 15 bp, Homo sapiens
tgaatttaagtaata

SEQ ID NO: 54399 - DNA, 15 bp, Homo sapiens
gaatttaagtaataa

SEQ ID NO: 54400 - DNA, 15 bp, Homo sapiens
aatttaagtaataaa

SEQ ID NO: 54401 - DNA, 15 bp, Homo sapiens
atttaagtaataaac

SEQ ID NO: 54402 - DNA, 15 bp, Homo sapiens
tttaagtaataaact

SEQ ID NO: 54403 - DNA, 15 bp, Homo sapiens
ttaagtaataaacta

SEQ ID NO: 54404 - DNA, 15 bp, Homo sapiens
taagtaataaactaa

SEQ ID NO: 54405 - DNA, 15 bp, Homo sapiens
aagtaataaactaag

SEQ ID NO: 54406 - DNA, 15 bp, Homo sapiens
agtaataaactaagt

SEQ ID NO: 54407 - DNA, 15 bp, Homo sapiens
gtaataaactaagta

SEQ ID NO: 54408 - DNA, 15 bp, Homo sapiens
taataaactaagtaa

SEQ ID NO: 54409 - DNA, 15 bp, Homo sapiens
aataaactaagtaaa

SEQ ID NO: 54410 - DNA, 15 bp, Homo sapiens
ataaactaagtaaaa

SEQ ID NO: 54411 - DNA, 15 bp, Homo sapiens
taaactaagtaaaat

SEQ ID NO: 54412 - DNA, 15 bp, Homo sapiens
aaactaagtaaaatt

SEQ ID NO: 54413 - DNA, 15 bp, Homo sapiens
aactaagtaaaattg

SEQ ID NO: 54414 - DNA, 15 bp, Homo sapiens
actaagtaaaattga

SEQ ID NO: 54415 - DNA, 15 bp, Homo sapiens
ctaagtaaaattgag

SEQ ID NO: 54416 - DNA, 15 bp, Homo sapiens
taagtaaaattgagc

SEQ ID NO: 54417 - DNA, 15 bp, Homo sapiens
aagtaaaattgagct

SEQ ID NO: 54418 - DNA, 15 bp, Homo sapiens
agtaaaattgagctt

SEQ ID NO: 54419 - DNA, 15 bp, Homo sapiens
gtaaaattgagcttt

SEQ ID NO: 54420 - DNA, 15 bp, Homo sapiens
taaaattgagcttta

SEQ ID NO: 54421 - DNA, 15 bp, Homo sapiens
aaaattgagctttaa

SEQ ID NO: 54422 - DNA, 15 bp, Homo sapiens
aaattgagctttaat

SEQ ID NO: 54423 - DNA, 15 bp, Homo sapiens
aattgagctttaatt

SEQ ID NO: 54424 - DNA, 15 bp, Homo sapiens
attgagctttaattc

SEQ ID NO: 54425 - DNA, 15 bp, Homo sapiens
ttgagctttaattca

SEQ ID NO: 54426 - DNA, 15 bp, Homo sapiens
tgagctttaattcaa

SEQ ID NO: 54427 - DNA, 15 bp, Homo sapiens
gagctttaattcaaa

SEQ ID NO: 54428 - DNA, 15 bp, Homo sapiens
agctttaattcaaaa

SEQ ID NO: 54429 - DNA, 15 bp, Homo sapiens
gctttaattcaaaat

SEQ ID NO: 54430 - DNA, 15 bp, Homo sapiens
ctttaattcaaaatt

SEQ ID NO: 54431 - DNA, 15 bp, Homo sapiens
tttaattcaaaattg

SEQ ID NO: 54432 - DNA, 15 bp, Homo sapiens
ttaattcaaaattgg

SEQ ID NO: 54433 - DNA, 15 bp, Homo sapiens
taattcaaaattggg

SEQ ID NO: 54434 - DNA, 15 bp, Homo sapiens
aattcaaaattgggt

SEQ ID NO: 54435 - DNA, 15 bp, Homo sapiens
attcaaaattgggta

SEQ ID NO: 54436 - DNA, 15 bp, Homo sapiens
ttcaaaattgggtat

SEQ ID NO: 54437 - DNA, 15 bp, Homo sapiens
tcaaaattgggtata

SEQ ID NO: 54438 - DNA, 15 bp, Homo sapiens
caaaattgggtataa

SEQ ID NO: 54439 - DNA, 15 bp, Homo sapiens
aaaattgggtataag

SEQ ID NO: 54440 - DNA, 15 bp, Homo sapiens
aaattgggtataagt

SEQ ID NO: 54441 - DNA, 15 bp, Homo sapiens
aattgggtataagta

SEQ ID NO: 54442 - DNA, 15 bp, Homo sapiens
attgggtataagtat

SEQ ID NO: 54443 - DNA, 15 bp, Homo sapiens
ttgggtataagtatt

SEQ ID NO: 54444 - DNA, 15 bp, Homo sapiens
tgggtataagtattt

SEQ ID NO: 54445 - DNA, 15 bp, Homo sapiens
gggtataagtatttt

SEQ ID NO: 54446 - DNA, 15 bp, Homo sapiens
ggtataagtatttta

SEQ ID NO: 54447 - DNA, 15 bp, Homo sapiens
gtataagtattttac

SEQ ID NO: 54448 - DNA, 15 bp, Homo sapiens
tataagtattttaca

SEQ ID NO: 54449 - DNA, 15 bp, Homo sapiens
ataagtattttacag

SEQ ID NO: 54450 - DNA, 15 bp, Homo sapiens
taagtattttacaga

SEQ ID NO: 54451 - DNA, 15 bp, Homo sapiens
aagtattttacagat

SEQ ID NO: 54452 - DNA, 15 bp, Homo sapiens
agtattttacagatt

SEQ ID NO: 54453 - DNA, 15 bp, Homo sapiens
gtattttacagatta

SEQ ID NO: 54454 - DNA, 15 bp, Homo sapiens
tattttacagattac

SEQ ID NO: 54455 - DNA, 15 bp, Homo sapiens
attttacagattacc

SEQ ID NO: 54456 - DNA, 15 bp, Homo sapiens
ttttacagattacct

SEQ ID NO: 54457 - DNA, 15 bp, Homo sapiens
tttacagattacctg

SEQ ID NO: 54458 - DNA, 15 bp, Homo sapiens
ttacagattacctga

SEQ ID NO: 54459 - DNA, 15 bp, Homo sapiens
tacagattacctgaa

SEQ ID NO: 54460 - DNA, 15 bp, Homo sapiens
acagattacctgaag

SEQ ID NO: 54461 - DNA, 15 bp, Homo sapiens
cagattacctgaagt

SEQ ID NO: 54462 - DNA, 15 bp, Homo sapiens
agattacctgaagtt

SEQ ID NO: 54463 - DNA, 15 bp, Homo sapiens
gattacctgaagttg

SEQ ID NO: 54464 - DNA, 15 bp, Homo sapiens
attacctgaagttgt

SEQ ID NO: 54465 - DNA, 15 bp, Homo sapiens
ttacctgaagttgtt

SEQ ID NO: 54466 - DNA, 15 bp, Homo sapiens
tacctgaagttgttg

SEQ ID NO: 54467 - DNA, 15 bp, Homo sapiens
acctgaagttgttgt

SEQ ID NO: 54468 - DNA, 15 bp, Homo sapiens
cctgaagttgttgtc

SEQ ID NO: 54469 - DNA, 15 bp, Homo sapiens
ctgaagttgttgtca

SEQ ID NO: 54470 - DNA, 15 bp, Homo sapiens
tgaagttgttgtcat

SEQ ID NO: 54471 - DNA, 15 bp, Homo sapiens
gaagttgttgtcatt

SEQ ID NO: 54472 - DNA, 15 bp, Homo sapiens
aagttgttgtcattt

SEQ ID NO: 54473 - DNA, 15 bp, Homo sapiens
agttgttgtcattta

SEQ ID NO: 54474 - DNA, 15 bp, Homo sapiens
gttgttgtcatttat

SEQ ID NO: 54475 - DNA, 15 bp, Homo sapiens
ttgttgtcatttatt

SEQ ID NO: 54476 - DNA, 15 bp, Homo sapiens
tgttgtcatttattt

SEQ ID NO: 54477 - DNA, 15 bp, Homo sapiens
gttgtcatttatttt

SEQ ID NO: 54478 - DNA, 15 bp, Homo sapiens
ttgtcatttattttt

SEQ ID NO: 54479 - DNA, 15 bp, Homo sapiens
tgtcatttatttttc

SEQ ID NO: 54480 - DNA, 15 bp, Homo sapiens
gtcatttatttttct

SEQ ID NO: 54481 - DNA, 15 bp, Homo sapiens
tcatttatttttctg

SEQ ID NO: 54482 - DNA, 15 bp, Homo sapiens
catttatttttctgg

SEQ ID NO: 54483 - DNA, 15 bp, Homo sapiens
atttatttttctgga

SEQ ID NO: 54484 - DNA, 15 bp, Homo sapiens
tttatttttctggag

SEQ ID NO: 54485 - DNA, 15 bp, Homo sapiens
ttatttttctggagg

SEQ ID NO: 54486 - DNA, 15 bp, Homo sapiens
tatttttctggagga

SEQ ID NO: 54487 - DNA, 15 bp, Homo sapiens
atttttctggaggag

SEQ ID NO: 54488 - DNA, 15 bp, Homo sapiens
tttttctggaggagg

SEQ ID NO: 54489 - DNA, 15 bp, Homo sapiens
ttttctggaggaggg

SEQ ID NO: 54490 - DNA, 15 bp, Homo sapiens
tttctggaggagggc

SEQ ID NO: 54491 - DNA, 15 bp, Homo sapiens
ttctggaggagggcg

SEQ ID NO: 54492 - DNA, 15 bp, Homo sapiens
tctggaggagggcgg

SEQ ID NO: 54493 - DNA, 15 bp, Homo sapiens
ctggaggagggcggg

SEQ ID NO: 54494 - DNA, 15 bp, Homo sapiens
tggaggagggcgggt

SEQ ID NO: 54495 - DNA, 15 bp, Homo sapiens
ggaggagggcgggtt

SEQ ID NO: 54496 - DNA, 15 bp, Homo sapiens
gaggagggcgggttg

SEQ ID NO: 54497 - DNA, 15 bp, Homo sapiens
aggagggcgggttga

SEQ ID NO: 54498 - DNA, 15 bp, Homo sapiens
ggagggcgggttgat

SEQ ID NO: 54499 - DNA, 15 bp, Homo sapiens
gagggcgggttgatg

SEQ ID NO: 54500 - DNA, 15 bp, Homo sapiens
agggcgggttgatga

SEQ ID NO: 54501 - DNA, 15 bp, Homo sapiens
gggcgggttgatgat

SEQ ID NO: 54502 - DNA, 15 bp, Homo sapiens
ggcgggttgatgatg

SEQ ID NO: 54503 - DNA, 15 bp, Homo sapiens
gcgggttgatgatgc

SEQ ID NO: 54504 - DNA, 15 bp, Homo sapiens
cgggttgatgatgct

SEQ ID NO: 54505 - DNA, 15 bp, Homo sapiens
gggttgatgatgctc

SEQ ID NO: 54506 - DNA, 15 bp, Homo sapiens
ggttgatgatgctct

SEQ ID NO: 54507 - DNA, 15 bp, Homo sapiens
gttgatgatgctctt

SEQ ID NO: 54508 - DNA, 15 bp, Homo sapiens
ttgatgatgctcttt

SEQ ID NO: 54509 - DNA, 15 bp, Homo sapiens
tgatgatgctcttta

SEQ ID NO: 54510 - DNA, 15 bp, Homo sapiens
gatgatgctctttaa

SEQ ID NO: 54511 - DNA, 15 bp, Homo sapiens
atgatgctctttaaa

SEQ ID NO: 54512 - DNA, 15 bp, Homo sapiens
tgatgctctttaaat

SEQ ID NO: 54513 - DNA, 15 bp, Homo sapiens
gatgctctttaaata

SEQ ID NO: 54514 - DNA, 15 bp, Homo sapiens
atgctctttaaatag

SEQ ID NO: 54515 - DNA, 15 bp, Homo sapiens
tgctctttaaatagt

SEQ ID NO: 54516 - DNA, 15 bp, Homo sapiens
gctctttaaatagtg

SEQ ID NO: 54517 - DNA, 15 bp, Homo sapiens
ctctttaaatagtgg

SEQ ID NO: 54518 - DNA, 15 bp, Homo sapiens
tctttaaatagtggc

SEQ ID NO: 54519 - DNA, 15 bp, Homo sapiens
ctttaaatagtggcc

SEQ ID NO: 54520 - DNA, 15 bp, Homo sapiens
tttaaatagtggcca

SEQ ID NO: 54521 - DNA, 15 bp, Homo sapiens
ttaaatagtggccag

SEQ ID NO: 54522 - DNA, 15 bp, Homo sapiens
taaatagtggccaga

SEQ ID NO: 54523 - DNA, 15 bp, Homo sapiens
aaatagtggccagaa

SEQ ID NO: 54524 - DNA, 15 bp, Homo sapiens
aatagtggccagaag

SEQ ID NO: 54525 - DNA, 15 bp, Homo sapiens
atagtggccagaagt

SEQ ID NO: 54526 - DNA, 15 bp, Homo sapiens
tagtggccagaagtc

SEQ ID NO: 54527 - DNA, 15 bp, Homo sapiens
agtggccagaagtca

SEQ ID NO: 54528 - DNA, 15 bp, Homo sapiens
gtggccagaagtcat

SEQ ID NO: 54529 - DNA, 15 bp, Homo sapiens
tggccagaagtcatt

SEQ ID NO: 54530 - DNA, 15 bp, Homo sapiens
ggccagaagtcattt

SEQ ID NO: 54531 - DNA, 15 bp, Homo sapiens
gccagaagtcatttg

SEQ ID NO: 54532 - DNA, 15 bp, Homo sapiens
ccagaagtcatttgg

SEQ ID NO: 54533 - DNA, 15 bp, Homo sapiens
cagaagtcatttggg

SEQ ID NO: 54534 - DNA, 15 bp, Homo sapiens
agaagtcatttgggc

SEQ ID NO: 54535 - DNA, 15 bp, Homo sapiens
gaagtcatttgggct

SEQ ID NO: 54536 - DNA, 15 bp, Homo sapiens
aagtcatttgggctc

SEQ ID NO: 54537 - DNA, 15 bp, Homo sapiens
agtcatttgggctct

SEQ ID NO: 54538 - DNA, 15 bp, Homo sapiens
gtcatttgggctctc

SEQ ID NO: 54539 - DNA, 15 bp, Homo sapiens
tcatttgggctctct

SEQ ID NO: 54540 - DNA, 15 bp, Homo sapiens
catttgggctctctt

SEQ ID NO: 54541 - DNA, 15 bp, Homo sapiens
atttgggctctcttt

SEQ ID NO: 54542 - DNA, 15 bp, Homo sapiens
tttgggctctctttg

SEQ ID NO: 54543 - DNA, 15 bp, Homo sapiens
ttgggctctctttgt

SEQ ID NO: 54544 - DNA, 15 bp, Homo sapiens
tgggctctctttgtc

SEQ ID NO: 54545 - DNA, 15 bp, Homo sapiens
gggctctctttgtct

SEQ ID NO: 54546 - DNA, 15 bp, Homo sapiens
ggctctctttgtctt

SEQ ID NO: 54547 - DNA, 15 bp, Homo sapiens
gctctctttgtcttc

SEQ ID NO: 54548 - DNA, 15 bp, Homo sapiens
ctctctttgtcttct

SEQ ID NO: 54549 - DNA, 15 bp, Homo sapiens
tctctttgtcttctt

SEQ ID NO: 54550 - DNA, 15 bp, Homo sapiens
ctctttgtcttcttt

SEQ ID NO: 54551 - DNA, 15 bp, Homo sapiens
tctttgtcttctttt

SEQ ID NO: 54552 - DNA, 15 bp, Homo sapiens
ctttgtcttcttttc

SEQ ID NO: 54553 - DNA, 15 bp, Homo sapiens
tttgtcttcttttct

SEQ ID NO: 54554 - DNA, 15 bp, Homo sapiens
ttgtcttcttttctt

SEQ ID NO: 54555 - DNA, 15 bp, Homo sapiens
tgtcttcttttcttg

SEQ ID NO: 54556 - DNA, 15 bp, Homo sapiens
gtcttcttttcttga

SEQ ID NO: 54557 - DNA, 15 bp, Homo sapiens
tcttcttttcttgat

SEQ ID NO: 54558 - DNA, 15 bp, Homo sapiens
cttcttttcttgatt

SEQ ID NO: 54559 - DNA, 15 bp, Homo sapiens
ttcttttcttgattg

SEQ ID NO: 54560 - DNA, 15 bp, Homo sapiens
tcttttcttgattgg

SEQ ID NO: 54561 - DNA, 15 bp, Homo sapiens
cttttcttgattgga

SEQ ID NO: 54562 - DNA, 15 bp, Homo sapiens
ttttcttgattggaa

SEQ ID NO: 54563 - DNA, 15 bp, Homo sapiens
tttcttgattggaaa

SEQ ID NO: 54564 - DNA, 15 bp, Homo sapiens
ttcttgattggaaac

SEQ ID NO: 54565 - DNA, 15 bp, Homo sapiens
tcttgattggaaaca

SEQ ID NO: 54566 - DNA, 15 bp, Homo sapiens
cttgattggaaacag

SEQ ID NO: 54567 - DNA, 15 bp, Homo sapiens
ttgattggaaacagt

SEQ ID NO: 54568 - DNA, 15 bp, Homo sapiens
tgattggaaacagta

SEQ ID NO: 54569 - DNA, 15 bp, Homo sapiens
gattggaaacagtat

SEQ ID NO: 54570 - DNA, 15 bp, Homo sapiens
attggaaacagtatt

SEQ ID NO: 54571 - DNA, 15 bp, Homo sapiens
ttggaaacagtattt

SEQ ID NO: 54572 - DNA, 15 bp, Homo sapiens
tggaaacagtatttt

SEQ ID NO: 54573 - DNA, 15 bp, Homo sapiens
ggaaacagtattttc

SEQ ID NO: 54574 - DNA, 15 bp, Homo sapiens
gaaacagtattttcc

SEQ ID NO: 54575 - DNA, 15 bp, Homo sapiens
aaacagtattttcct

SEQ ID NO: 54576 - DNA, 15 bp, Homo sapiens
aacagtattttcctg

SEQ ID NO: 54577 - DNA, 15 bp, Homo sapiens
acagtattttcctga

SEQ ID NO: 54578 - DNA, 15 bp, Homo sapiens
cagtattttcctgac

SEQ ID NO: 54579 - DNA, 15 bp, Homo sapiens
agtattttcctgaca

SEQ ID NO: 54580 - DNA, 15 bp, Homo sapiens
gtattttcctgacag

SEQ ID NO: 54581 - DNA, 15 bp, Homo sapiens
tattttcctgacagc

SEQ ID NO: 54582 - DNA, 15 bp, Homo sapiens
attttcctgacagca

SEQ ID NO: 54583 - DNA, 15 bp, Homo sapiens
ttttcctgacagcag

SEQ ID NO: 54584 - DNA, 15 bp, Homo sapiens
tttcctgacagcagc

SEQ ID NO: 54585 - DNA, 15 bp, Homo sapiens
ttcctgacagcagcc

SEQ ID NO: 54586 - DNA, 15 bp, Homo sapiens
tcctgacagcagccc

SEQ ID NO: 54587 - DNA, 15 bp, Homo sapiens
cctgacagcagccct

SEQ ID NO: 54588 - DNA, 15 bp, Homo sapiens
ctgacagcagccctt

SEQ ID NO: 54589 - DNA, 15 bp, Homo sapiens
tgacagcagcccttg

SEQ ID NO: 54590 - DNA, 15 bp, Homo sapiens
gacagcagcccttgg

SEQ ID NO: 54591 - DNA, 15 bp, Homo sapiens
acagcagcccttgga

SEQ ID NO: 54592 - DNA, 15 bp, Homo sapiens
cagcagcccttggat

SEQ ID NO: 54593 - DNA, 15 bp, Homo sapiens
agcagcccttggatt

SEQ ID NO: 54594 - DNA, 15 bp, Homo sapiens
gcagcccttggattt

SEQ ID NO: 54595 - DNA, 15 bp, Homo sapiens
cagcccttggatttc

SEQ ID NO: 54596 - DNA, 15 bp, Homo sapiens
agcccttggatttcc

SEQ ID NO: 54597 - DNA, 15 bp, Homo sapiens
gcccttggatttccc

SEQ ID NO: 54598 - DNA, 15 bp, Homo sapiens
cccttggatttcccg

SEQ ID NO: 54599 - DNA, 15 bp, Homo sapiens
ccttggatttcccga

SEQ ID NO: 54600 - DNA, 15 bp, Homo sapiens
cttggatttcccgag

SEQ ID NO: 54601 - DNA, 15 bp, Homo sapiens
ttggatttcccgagg

SEQ ID NO: 54602 - DNA, 15 bp, Homo sapiens
tggatttcccgaggc

SEQ ID NO: 54603 - DNA, 15 bp, Homo sapiens
ggatttcccgaggct

SEQ ID NO: 54604 - DNA, 15 bp, Homo sapiens
gatttcccgaggctt

SEQ ID NO: 54605 - DNA, 15 bp, Homo sapiens
atttcccgaggcttt

SEQ ID NO: 54606 - DNA, 15 bp, Homo sapiens
tttcccgaggctttg

SEQ ID NO: 54607 - DNA, 15 bp, Homo sapiens
ttcccgaggctttga

SEQ ID NO: 54608 - DNA, 15 bp, Homo sapiens
tcccgaggctttgat

SEQ ID NO: 54609 - DNA, 15 bp, Homo sapiens
cccgaggctttgatt

SEQ ID NO: 54610 - DNA, 15 bp, Homo sapiens
ccgaggctttgattc

SEQ ID NO: 54611 - DNA, 15 bp, Homo sapiens
cgaggctttgattcc

SEQ ID NO: 54612 - DNA, 15 bp, Homo sapiens
gaggctttgattcct

SEQ ID NO: 54613 - DNA, 15 bp, Homo sapiens
aggctttgattcctg

SEQ ID NO: 54614 - DNA, 15 bp, Homo sapiens
ggctttgattcctgt

SEQ ID NO: 54615 - DNA, 15 bp, Homo sapiens
gctttgattcctgtt

SEQ ID NO: 54616 - DNA, 15 bp, Homo sapiens
ctttgattcctgttc

SEQ ID NO: 54617 - DNA, 15 bp, Homo sapiens
tttgattcctgttca

SEQ ID NO: 54618 - DNA, 15 bp, Homo sapiens
ttgattcctgttcag

SEQ ID NO: 54619 - DNA, 15 bp, Homo sapiens
tgattcctgttcagc

SEQ ID NO: 54620 - DNA, 15 bp, Homo sapiens
gattcctgttcagct

SEQ ID NO: 54621 - DNA, 15 bp, Homo sapiens
attcctgttcagctg

SEQ ID NO: 54622 - DNA, 15 bp, Homo sapiens
ttcctgttcagctgc

SEQ ID NO: 54623 - DNA, 15 bp, Homo sapiens
tcctgttcagctgct

SEQ ID NO: 54624 - DNA, 15 bp, Homo sapiens
cctgttcagctgctc

SEQ ID NO: 54625 - DNA, 15 bp, Homo sapiens
ctgttcagctgctct

SEQ ID NO: 54626 - DNA, 15 bp, Homo sapiens
tgttcagctgctctg

SEQ ID NO: 54627 - DNA, 15 bp, Homo sapiens
gttcagctgctctgg

SEQ ID NO: 54628 - DNA, 15 bp, Homo sapiens
ttcagctgctctggg

SEQ ID NO: 54629 - DNA, 15 bp, Homo sapiens
tcagctgctctgggt

SEQ ID NO: 54630 - DNA, 15 bp, Homo sapiens
cagctgctctgggtc

SEQ ID NO: 54631 - DNA, 15 bp, Homo sapiens
agctgctctgggtca

SEQ ID NO: 54632 - DNA, 15 bp, Homo sapiens
gctgctctgggtcaa

SEQ ID NO: 54633 - DNA, 15 bp, Homo sapiens
ctgctctgggtcaat

SEQ ID NO: 54634 - DNA, 15 bp, Homo sapiens
tgctctgggtcaatc

SEQ ID NO: 54635 - DNA, 15 bp, Homo sapiens
gctctgggtcaatct

SEQ ID NO: 54636 - DNA, 15 bp, Homo sapiens
ctctgggtcaatctg

SEQ ID NO: 54637 - DNA, 15 bp, Homo sapiens
tctgggtcaatctgg

SEQ ID NO: 54638 - DNA, 15 bp, Homo sapiens
ctgggtcaatctggt

SEQ ID NO: 54639 - DNA, 15 bp, Homo sapiens
tgggtcaatctggtg

SEQ ID NO: 54640 - DNA, 15 bp, Homo sapiens
gggtcaatctggtga

SEQ ID NO: 54641 - DNA, 15 bp, Homo sapiens
ggtcaatctggtgac

SEQ ID NO: 54642 - DNA, 15 bp, Homo sapiens
gtcaatctggtgaca

SEQ ID NO: 54643 - DNA, 15 bp, Homo sapiens
tcaatctggtgacag

SEQ ID NO: 54644 - DNA, 15 bp, Homo sapiens
aatctggtgacagat

SEQ ID NO: 54645 - DNA, 15 bp, Homo sapiens
atctggtgacagatg

SEQ ID NO: 54646 - DNA, 15 bp, Homo sapiens
tctggtgacagatgg

SEQ ID NO: 54647 - DNA, 15 bp, Homo sapiens
ctggtgacagatggc

SEQ ID NO: 54648 - DNA, 15 bp, Homo sapiens
tggtgacagatggcc

SEQ ID NO: 54649 - DNA, 15 bp, Homo sapiens
ggtgacagatggcct

SEQ ID NO: 54650 - DNA, 15 bp, Homo sapiens
gtgacagatggcctg

SEQ ID NO: 54651 - DNA, 15 bp, Homo sapiens
tgacagatggcctgc

SEQ ID NO: 54652 - DNA, 15 bp, Homo sapiens
gacagatggcctgcc

SEQ ID NO: 54653 - DNA, 15 bp, Homo sapiens
acagatggcctgcct

SEQ ID NO: 54654 - DNA, 15 bp, Homo sapiens
cagatggcctgcctg

SEQ ID NO: 54655 - DNA, 15 bp, Homo sapiens
agatggcctgcctgc

SEQ ID NO: 54656 - DNA, 15 bp, Homo sapiens
gatggcctgcctgcc

SEQ ID NO: 54657 - DNA, 15 bp, Homo sapiens
atggcctgcctgcca

SEQ ID NO: 54658 - DNA, 15 bp, Homo sapiens
tggcctgcctgccac

SEQ ID NO: 54659 - DNA, 15 bp, Homo sapiens
ggcctgcctgccact

SEQ ID NO: 54660 - DNA, 15 bp, Homo sapiens
gcctgcctgccactg

SEQ ID NO: 54661 - DNA, 15 bp, Homo sapiens
cctgcctgccactgc

SEQ ID NO: 54662 - DNA, 15 bp, Homo sapiens
ctgcctgccactgca

SEQ ID NO: 54663 - DNA, 15 bp, Homo sapiens
tgcctgccactgcac

SEQ ID NO: 54664 - DNA, 15 bp, Homo sapiens
gcctgccactgcact

SEQ ID NO: 54665 - DNA, 15 bp, Homo sapiens
cctgccactgcactg

SEQ ID NO: 54666 - DNA, 15 bp, Homo sapiens
ctgccactgcactgg

SEQ ID NO: 54667 - DNA, 15 bp, Homo sapiens
tgccactgcactggg

SEQ ID NO: 54668 - DNA, 15 bp, Homo sapiens
gccactgcactgggg

SEQ ID NO: 54669 - DNA, 15 bp, Homo sapiens
ccactgcactggggt

SEQ ID NO: 54670 - DNA, 15 bp, Homo sapiens
cactgcactggggtt

SEQ ID NO: 54671 - DNA, 15 bp, Homo sapiens
actgcactggggttc

SEQ ID NO: 54672 - DNA, 15 bp, Homo sapiens
ctgcactggggttca

SEQ ID NO: 54673 - DNA, 15 bp, Homo sapiens
tgcactggggttcaa

SEQ ID NO: 54674 - DNA, 15 bp, Homo sapiens
gcactggggttcaac

SEQ ID NO: 54675 - DNA, 15 bp, Homo sapiens
cactggggttcaacc

SEQ ID NO: 54676 - DNA, 15 bp, Homo sapiens
actggggttcaaccc

SEQ ID NO: 54677 - DNA, 15 bp, Homo sapiens
ctggggttcaaccct

SEQ ID NO: 54678 - DNA, 15 bp, Homo sapiens
tggggttcaaccctc

SEQ ID NO: 54679 - DNA, 15 bp, Homo sapiens
ggggttcaaccctcc

SEQ ID NO: 54680 - DNA, 15 bp, Homo sapiens
gggttcaaccctcct

SEQ ID NO: 54681 - DNA, 15 bp, Homo sapiens
ggttcaaccctcctg

SEQ ID NO: 54682 - DNA, 15 bp, Homo sapiens
gttcaaccctcctga

SEQ ID NO: 54683 - DNA, 15 bp, Homo sapiens
ttcaaccctcctgat

SEQ ID NO: 54684 - DNA, 15 bp, Homo sapiens
tcaaccctcctgatc

SEQ ID NO: 54685 - DNA, 15 bp, Homo sapiens
caaccctcctgatct

SEQ ID NO: 54686 - DNA, 15 bp, Homo sapiens
aaccctcctgatctg

SEQ ID NO: 54687 - DNA, 15 bp, Homo sapiens
accctcctgatctgg

SEQ ID NO: 54688 - DNA, 15 bp, Homo sapiens
ccctcctgatctgga

SEQ ID NO: 54689 - DNA, 15 bp, Homo sapiens
cctcctgatctggac

SEQ ID NO: 54690 - DNA, 15 bp, Homo sapiens
ctcctgatctggaca

SEQ ID NO: 54691 - DNA, 15 bp, Homo sapiens
tcctgatctggacat

SEQ ID NO: 54692 - DNA, 15 bp, Homo sapiens
cctgatctggacatc

SEQ ID NO: 54693 - DNA, 15 bp, Homo sapiens
ctgatctggacatca

SEQ ID NO: 54694 - DNA, 15 bp, Homo sapiens
tgatctggacatcat

SEQ ID NO: 54695 - DNA, 15 bp, Homo sapiens
gatctggacatcatg

SEQ ID NO: 54696 - DNA, 15 bp, Homo sapiens
atctggacatcatga

SEQ ID NO: 54697 - DNA, 15 bp, Homo sapiens
tctggacatcatgaa

SEQ ID NO: 54698 - DNA, 15 bp, Homo sapiens
ctggacatcatgaat

SEQ ID NO: 54699 - DNA, 15 bp, Homo sapiens
tggacatcatgaata

SEQ ID NO: 54700 - DNA, 15 bp, Homo sapiens
ggacatcatgaataa

SEQ ID NO: 54701 - DNA, 15 bp, Homo sapiens
gacatcatgaataaa

SEQ ID NO: 54702 - DNA, 15 bp, Homo sapiens
acatcatgaataaac

SEQ ID NO: 54703 - DNA, 15 bp, Homo sapiens
catcatgaataaacc

SEQ ID NO: 54704 - DNA, 15 bp, Homo sapiens
atcatgaataaacct

SEQ ID NO: 54705 - DNA, 15 bp, Homo sapiens
tcatgaataaacctc

SEQ ID NO: 54706 - DNA, 15 bp, Homo sapiens
catgaataaacctcc

SEQ ID NO: 54707 - DNA, 15 bp, Homo sapiens
atgaataaacctccc

SEQ ID NO: 54708 - DNA, 15 bp, Homo sapiens
tgaataaacctcccc

SEQ ID NO: 54709 - DNA, 15 bp, Homo sapiens
gaataaacctccccg

SEQ ID NO: 54710 - DNA, 15 bp, Homo sapiens
aataaacctccccgg

SEQ ID NO: 54711 - DNA, 15 bp, Homo sapiens
ataaacctccccgga

SEQ ID NO: 54712 - DNA, 15 bp, Homo sapiens
taaacctccccggaa

SEQ ID NO: 54713 - DNA, 15 bp, Homo sapiens
aaacctccccggaac

SEQ ID NO: 54714 - DNA, 15 bp, Homo sapiens
aacctccccggaacc

SEQ ID NO: 54715 - DNA, 15 bp, Homo sapiens
acctccccggaaccc

SEQ ID NO: 54716 - DNA, 15 bp, Homo sapiens
cctccccggaaccca

SEQ ID NO: 54717 - DNA, 15 bp, Homo sapiens
ctccccggaacccaa

SEQ ID NO: 54718 - DNA, 15 bp, Homo sapiens
tccccggaacccaaa

SEQ ID NO: 54719 - DNA, 15 bp, Homo sapiens
ccccggaacccaaag

SEQ ID NO: 54720 - DNA, 15 bp, Homo sapiens
cccggaacccaaagg

SEQ ID NO: 54721 - DNA, 15 bp, Homo sapiens
ccggaacccaaagga

SEQ ID NO: 54722 - DNA, 15 bp, Homo sapiens
cggaacccaaaggaa

SEQ ID NO: 54723 - DNA, 15 bp, Homo sapiens
ggaacccaaaggaac

SEQ ID NO: 54724 - DNA, 15 bp, Homo sapiens
gaacccaaaggaacc

SEQ ID NO: 54725 - DNA, 15 bp, Homo sapiens
aacccaaaggaacca

SEQ ID NO: 54726 - DNA, 15 bp, Homo sapiens
acccaaaggaaccat

SEQ ID NO: 54727 - DNA, 15 bp, Homo sapiens
cccaaaggaaccatt

SEQ ID NO: 54728 - DNA, 15 bp, Homo sapiens
ccaaaggaaccattg

SEQ ID NO: 54729 - DNA, 15 bp, Homo sapiens
caaaggaaccattga

SEQ ID NO: 54730 - DNA, 15 bp, Homo sapiens
aaaggaaccattgat

SEQ ID NO: 54731 - DNA, 15 bp, Homo sapiens
aaggaaccattgatc

SEQ ID NO: 54732 - DNA, 15 bp, Homo sapiens
aggaaccattgatca

SEQ ID NO: 54733 - DNA, 15 bp, Homo sapiens
ggaaccattgatcag

SEQ ID NO: 54734 - DNA, 15 bp, Homo sapiens
gaaccattgatcagc

SEQ ID NO: 54735 - DNA, 15 bp, Homo sapiens
aaccattgatcagcg

SEQ ID NO: 54736 - DNA, 15 bp, Homo sapiens
accattgatcagcgg

SEQ ID NO: 54737 - DNA, 15 bp, Homo sapiens
ccattgatcagcggg

SEQ ID NO: 54738 - DNA, 15 bp, Homo sapiens
cattgatcagcgggt

SEQ ID NO: 54739 - DNA, 15 bp, Homo sapiens
attgatcagcgggtg

SEQ ID NO: 54740 - DNA, 15 bp, Homo sapiens
ttgatcagcgggtgg

SEQ ID NO: 54741 - DNA, 15 bp, Homo sapiens
tgatcagcgggtggc

SEQ ID NO: 54742 - DNA, 15 bp, Homo sapiens
gatcagcgggtggct

SEQ ID NO: 54743 - DNA, 15 bp, Homo sapiens
atcagcgggtggctc

SEQ ID NO: 54744 - DNA, 15 bp, Homo sapiens
tcagcgggtggctct

SEQ ID NO: 54745 - DNA, 15 bp, Homo sapiens
cagcgggtggctctt

SEQ ID NO: 54746 - DNA, 15 bp, Homo sapiens
agcgggtggctcttt

SEQ ID NO: 54747 - DNA, 15 bp, Homo sapiens
gcgggtggctctttt

SEQ ID NO: 54748 - DNA, 15 bp, Homo sapiens
cgggtggctcttttt

SEQ ID NO: 54749 - DNA, 15 bp, Homo sapiens
gggtggctctttttc

SEQ ID NO: 54750 - DNA, 15 bp, Homo sapiens
ggtggctctttttcc

SEQ ID NO: 54751 - DNA, 15 bp, Homo sapiens
gtggctctttttccg

SEQ ID NO: 54752 - DNA, 15 bp, Homo sapiens
tggctctttttccgt

SEQ ID NO: 54753 - DNA, 15 bp, Homo sapiens
ggctctttttccgtt

SEQ ID NO: 54754 - DNA, 15 bp, Homo sapiens
gctctttttccgtta

SEQ ID NO: 54755 - DNA, 15 bp, Homo sapiens
ctctttttccgttac

SEQ ID NO: 54756 - DNA, 15 bp, Homo sapiens
tctttttccgttact

SEQ ID NO: 54757 - DNA, 15 bp, Homo sapiens
ctttttccgttactt

SEQ ID NO: 54758 - DNA, 15 bp, Homo sapiens
tttttccgttacttg

SEQ ID NO: 54759 - DNA, 15 bp, Homo sapiens
ttttccgttacttgg

SEQ ID NO: 54760 - DNA, 15 bp, Homo sapiens
tttccgttacttggc

SEQ ID NO: 54761 - DNA, 15 bp, Homo sapiens
ttccgttacttggct

SEQ ID NO: 54762 - DNA, 15 bp, Homo sapiens
tccgttacttggcta

SEQ ID NO: 54763 - DNA, 15 bp, Homo sapiens
ccgttacttggctat

SEQ ID NO: 54764 - DNA, 15 bp, Homo sapiens
cgttacttggctatt

SEQ ID NO: 54765 - DNA, 15 bp, Homo sapiens
gttacttggctattg

SEQ ID NO: 54766 - DNA, 15 bp, Homo sapiens
ttacttggctattgg

SEQ ID NO: 54767 - DNA, 15 bp, Homo sapiens
tacttggctattggc

SEQ ID NO: 54768 - DNA, 15 bp, Homo sapiens
acttggctattggct

SEQ ID NO: 54769 - DNA, 15 bp, Homo sapiens
cttggctattggctg

SEQ ID NO: 54770 - DNA, 15 bp, Homo sapiens
ttggctattggctgt

SEQ ID NO: 54771 - DNA, 15 bp, Homo sapiens
tggctattggctgtg

SEQ ID NO: 54772 - DNA, 15 bp, Homo sapiens
ggctattggctgtga

SEQ ID NO: 54773 - DNA, 15 bp, Homo sapiens
gctattggctgtgag

SEQ ID NO: 54774 - DNA, 15 bp, Homo sapiens
ctattggctgtgagt

SEQ ID NO: 54775 - DNA, 15 bp, Homo sapiens
tattggctgtgagta

SEQ ID NO: 54776 - DNA, 15 bp, Homo sapiens
attggctgtgagtac

SEQ ID NO: 54777 - DNA, 15 bp, Homo sapiens
ttggctgtgagtaca

SEQ ID NO: 54778 - DNA, 15 bp, Homo sapiens
tggctgtgagtacaa

SEQ ID NO: 54779 - DNA, 15 bp, Homo sapiens
ggctgtgagtacaat

SEQ ID NO: 54780 - DNA, 15 bp, Homo sapiens
gctgtgagtacaatt

SEQ ID NO: 54781 - DNA, 15 bp, Homo sapiens
ctgtgagtacaattt

SEQ ID NO: 54782 - DNA, 15 bp, Homo sapiens
tgtgagtacaatttt

SEQ ID NO: 54783 - DNA, 15 bp, Homo sapiens
gtgagtacaattttt

SEQ ID NO: 54784 - DNA, 15 bp, Homo sapiens
tgagtacaatttttt

SEQ ID NO: 54785 - DNA, 15 bp, Homo sapiens
gagtacaattttttt

SEQ ID NO: 54786 - DNA, 15 bp, Homo sapiens
agtacaattttttta

SEQ ID NO: 54787 - DNA, 15 bp, Homo sapiens
gtacaatttttttat

SEQ ID NO: 54788 - DNA, 15 bp, Homo sapiens
tacaatttttttata

SEQ ID NO: 54789 - DNA, 15 bp, Homo sapiens
acaatttttttatat

SEQ ID NO: 54790 - DNA, 15 bp, Homo sapiens
caatttttttatatt

SEQ ID NO: 54791 - DNA, 15 bp, Homo sapiens
aatttttttatatta

SEQ ID NO: 54792 - DNA, 15 bp, Homo sapiens
atttttttatattac

SEQ ID NO: 54793 - DNA, 15 bp, Homo sapiens
tttttttatattact

SEQ ID NO: 54794 - DNA, 15 bp, Homo sapiens
ttttttatattactg

SEQ ID NO: 54795 - DNA, 15 bp, Homo sapiens
tttttatattactga

SEQ ID NO: 54796 - DNA, 15 bp, Homo sapiens
ttttatattactgat

SEQ ID NO: 54797 - DNA, 15 bp, Homo sapiens
tttatattactgatt

SEQ ID NO: 54798 - DNA, 15 bp, Homo sapiens
ttatattactgattt

SEQ ID NO: 54799 - DNA, 15 bp, Homo sapiens
tatattactgatttt

SEQ ID NO: 54800 - DNA, 15 bp, Homo sapiens
atattactgattttt

SEQ ID NO: 54801 - DNA, 15 bp, Homo sapiens
tattactgattttta

SEQ ID NO: 54802 - DNA, 15 bp, Homo sapiens
attactgatttttaa

SEQ ID NO: 54803 - DNA, 15 bp, Homo sapiens
ttactgatttttaaa

SEQ ID NO: 54804 - DNA, 15 bp, Homo sapiens
tactgatttttaaac

SEQ ID NO: 54805 - DNA, 15 bp, Homo sapiens
actgatttttaaaca

SEQ ID NO: 54806 - DNA, 15 bp, Homo sapiens
ctgatttttaaacaa

SEQ ID NO: 54807 - DNA, 15 bp, Homo sapiens
tgatttttaaacaaa

SEQ ID NO: 54808 - DNA, 15 bp, Homo sapiens
gatttttaaacaaaa

SEQ ID NO: 54809 - DNA, 15 bp, Homo sapiens
atttttaaacaaaat

SEQ ID NO: 54810 - DNA, 15 bp, Homo sapiens
tttttaaacaaaatg

SEQ ID NO: 54811 - DNA, 15 bp, Homo sapiens
ttttaaacaaaatgt

SEQ ID NO: 54812 - DNA, 15 bp, Homo sapiens
tttaaacaaaatgtt

SEQ ID NO: 54813 - DNA, 15 bp, Homo sapiens
ttaaacaaaatgttt

SEQ ID NO: 54814 - DNA, 15 bp, Homo sapiens
taaacaaaatgtttg

SEQ ID NO: 54815 - DNA, 15 bp, Homo sapiens
aaacaaaatgtttgt

SEQ ID NO: 54816 - DNA, 15 bp, Homo sapiens
aacaaaatgtttgtg

SEQ ID NO: 54817 - DNA, 15 bp, Homo sapiens
acaaaatgtttgtga

SEQ ID NO: 54818 - DNA, 15 bp, Homo sapiens
caaaatgtttgtgag

SEQ ID NO: 54819 - DNA, 15 bp, Homo sapiens
aaaatgtttgtgagc

SEQ ID NO: 54820 - DNA, 15 bp, Homo sapiens
aaatgtttgtgagct

SEQ ID NO: 54821 - DNA, 15 bp, Homo sapiens
aatgtttgtgagctg

SEQ ID NO: 54822 - DNA, 15 bp, Homo sapiens
atgtttgtgagctga

SEQ ID NO: 54823 - DNA, 15 bp, Homo sapiens
tgtttgtgagctgaa

SEQ ID NO: 54824 - DNA, 15 bp, Homo sapiens
gtttgtgagctgaaa

SEQ ID NO: 54825 - DNA, 15 bp, Homo sapiens
tttgtgagctgaaat

SEQ ID NO: 54826 - DNA, 15 bp, Homo sapiens
ttgtgagctgaaatt

SEQ ID NO: 54827 - DNA, 15 bp, Homo sapiens
tgtgagctgaaattt

SEQ ID NO: 54828 - DNA, 15 bp, Homo sapiens
gtgagctgaaatttt

SEQ ID NO: 54829 - DNA, 15 bp, Homo sapiens
tgagctgaaattttg

SEQ ID NO: 54830 - DNA, 15 bp, Homo sapiens
gagctgaaattttgt

SEQ ID NO: 54831 - DNA, 15 bp, Homo sapiens
agctgaaattttgta

SEQ ID NO: 54832 - DNA, 15 bp, Homo sapiens
gctgaaattttgtaa

SEQ ID NO: 54833 - DNA, 15 bp, Homo sapiens
ctgaaattttgtaaa

SEQ ID NO: 54834 - DNA, 15 bp, Homo sapiens
tgaaattttgtaaat

SEQ ID NO: 54835 - DNA, 15 bp, Homo sapiens
gaaattttgtaaatt

SEQ ID NO: 54836 - DNA, 15 bp, Homo sapiens
aaattttgtaaattc

SEQ ID NO: 54837 - DNA, 15 bp, Homo sapiens
aattttgtaaattca

SEQ ID NO: 54838 - DNA, 15 bp, Homo sapiens
attttgtaaattcat

SEQ ID NO: 54839 - DNA, 15 bp, Homo sapiens
ttttgtaaattcatc

SEQ ID NO: 54840 - DNA, 15 bp, Homo sapiens
tttgtaaattcatcc

SEQ ID NO: 54841 - DNA, 15 bp, Homo sapiens
ttgtaaattcatccc

SEQ ID NO: 54842 - DNA, 15 bp, Homo sapiens
tgtaaattcatccct

SEQ ID NO: 54843 - DNA, 15 bp, Homo sapiens
gtaaattcatccctt

SEQ ID NO: 54844 - DNA, 15 bp, Homo sapiens
taaattcatccctta

SEQ ID NO: 54845 - DNA, 15 bp, Homo sapiens
aaattcatcccttaa

SEQ ID NO: 54846 - DNA, 15 bp, Homo sapiens
aattcatcccttaaa

SEQ ID NO: 54847 - DNA, 15 bp, Homo sapiens
attcatcccttaaaa

SEQ ID NO: 54848 - DNA, 15 bp, Homo sapiens
ttcatcccttaaaag

SEQ ID NO: 54849 - DNA, 15 bp, Homo sapiens
tcatcccttaaaagc

SEQ ID NO: 54850 - DNA, 15 bp, Homo sapiens
catcccttaaaagcg

SEQ ID NO: 54851 - DNA, 15 bp, Homo sapiens
atcccttaaaagcgt

SEQ ID NO: 54852 - DNA, 15 bp, Homo sapiens
tcccttaaaagcgtg

SEQ ID NO: 54853 - DNA, 15 bp, Homo sapiens
cccttaaaagcgtgt

SEQ ID NO: 54854 - DNA, 15 bp, Homo sapiens
ccttaaaagcgtgtt

SEQ ID NO: 54855 - DNA, 15 bp, Homo sapiens
cttaaaagcgtgttt

SEQ ID NO: 54856 - DNA, 15 bp, Homo sapiens
ttaaaagcgtgtttt

SEQ ID NO: 54857 - DNA, 15 bp, Homo sapiens
taaaagcgtgttttt

SEQ ID NO: 54858 - DNA, 15 bp, Homo sapiens
aaaagcgtgtttttt

SEQ ID NO: 54859 - DNA, 15 bp, Homo sapiens
aaagcgtgttttttc

SEQ ID NO: 54860 - DNA, 15 bp, Homo sapiens
aagcgtgttttttct

SEQ ID NO: 54861 - DNA, 15 bp, Homo sapiens
agcgtgttttttctt

SEQ ID NO: 54862 - DNA, 15 bp, Homo sapiens
gcgtgttttttcttc

SEQ ID NO: 54863 - DNA, 15 bp, Homo sapiens
cgtgttttttcttct

SEQ ID NO: 54864 - DNA, 15 bp, Homo sapiens
gtgttttttcttcta

SEQ ID NO: 54865 - DNA, 15 bp, Homo sapiens
tgttttttcttctat

SEQ ID NO: 54866 - DNA, 15 bp, Homo sapiens
gttttttcttctatc

SEQ ID NO: 54867 - DNA, 15 bp, Homo sapiens
ttttttcttctatcc

SEQ ID NO: 54868 - DNA, 15 bp, Homo sapiens
tttttcttctatccc

SEQ ID NO: 54869 - DNA, 15 bp, Homo sapiens
ttttcttctatcccc

SEQ ID NO: 54870 - DNA, 15 bp, Homo sapiens
tttcttctatccccg

SEQ ID NO: 54871 - DNA, 15 bp, Homo sapiens
ttcttctatccccgt

SEQ ID NO: 54872 - DNA, 15 bp, Homo sapiens
tcttctatccccgta

SEQ ID NO: 54873 - DNA, 15 bp, Homo sapiens
cttctatccccgtat

SEQ ID NO: 54874 - DNA, 15 bp, Homo sapiens
ttctatccccgtata

SEQ ID NO: 54875 - DNA, 15 bp, Homo sapiens
tctatccccgtatag

SEQ ID NO: 54876 - DNA, 15 bp, Homo sapiens
ctatccccgtatagg

SEQ ID NO: 54877 - DNA, 15 bp, Homo sapiens
tatccccgtataggg

SEQ ID NO: 54878 - DNA, 15 bp, Homo sapiens
atccccgtatagggt

SEQ ID NO: 54879 - DNA, 15 bp, Homo sapiens
tccccgtatagggta

SEQ ID NO: 54880 - DNA, 15 bp, Homo sapiens
ccccgtatagggtag

SEQ ID NO: 54881 - DNA, 15 bp, Homo sapiens
cccgtatagggtagc

SEQ ID NO: 54882 - DNA, 15 bp, Homo sapiens
ccgtatagggtagca

SEQ ID NO: 54883 - DNA, 15 bp, Homo sapiens
cgtatagggtagcaa

SEQ ID NO: 54884 - DNA, 15 bp, Homo sapiens
gtatagggtagcaaa

SEQ ID NO: 54885 - DNA, 15 bp, Homo sapiens
tatagggtagcaaaa

SEQ ID NO: 54886 - DNA, 15 bp, Homo sapiens
atagggtagcaaaag

SEQ ID NO: 54887 - DNA, 15 bp, Homo sapiens
tagggtagcaaaaga

SEQ ID NO: 54888 - DNA, 15 bp, Homo sapiens
agggtagcaaaagac

SEQ ID NO: 54889 - DNA, 15 bp, Homo sapiens
gggtagcaaaagaca

SEQ ID NO: 54890 - DNA, 15 bp, Homo sapiens
ggtagcaaaagacag

SEQ ID NO: 54891 - DNA, 15 bp, Homo sapiens
gtagcaaaagacaga

SEQ ID NO: 54892 - DNA, 15 bp, Homo sapiens
tagcaaaagacagag

SEQ ID NO: 54893 - DNA, 15 bp, Homo sapiens
agcaaaagacagaga

SEQ ID NO: 54894 - DNA, 15 bp, Homo sapiens
gcaaaagacagagat

SEQ ID NO: 54895 - DNA, 15 bp, Homo sapiens
caaaagacagagatg

SEQ ID NO: 54896 - DNA, 15 bp, Homo sapiens
aaaagacagagatgc

SEQ ID NO: 54897 - DNA, 15 bp, Homo sapiens
aaagacagagatgcc

SEQ ID NO: 54898 - DNA, 15 bp, Homo sapiens
aagacagagatgccc

SEQ ID NO: 54899 - DNA, 15 bp, Homo sapiens
agacagagatgccct

SEQ ID NO: 54900 - DNA, 15 bp, Homo sapiens
gacagagatgccctc

SEQ ID NO: 54901 - DNA, 15 bp, Homo sapiens
acagagatgccctct

SEQ ID NO: 54902 - DNA, 15 bp, Homo sapiens
cagagatgccctctt

SEQ ID NO: 54903 - DNA, 15 bp, Homo sapiens
agagatgccctctta

SEQ ID NO: 54904 - DNA, 15 bp, Homo sapiens
gagatgccctcttac

SEQ ID NO: 54905 - DNA, 15 bp, Homo sapiens
agatgccctcttaca

SEQ ID NO: 54906 - DNA, 15 bp, Homo sapiens
gatgccctcttacag

SEQ ID NO: 54907 - DNA, 15 bp, Homo sapiens
atgccctcttacagt

SEQ ID NO: 54908 - DNA, 15 bp, Homo sapiens
tgccctcttacagtt

SEQ ID NO: 54909 - DNA, 15 bp, Homo sapiens
gccctcttacagttc

SEQ ID NO: 54910 - DNA, 15 bp, Homo sapiens
ccctcttacagttcg

SEQ ID NO: 54911 - DNA, 15 bp, Homo sapiens
cctcttacagttcga

SEQ ID NO: 54912 - DNA, 15 bp, Homo sapiens
ctcttacagttcgat

SEQ ID NO: 54913 - DNA, 15 bp, Homo sapiens
tcttacagttcgatg

SEQ ID NO: 54914 - DNA, 15 bp, Homo sapiens
cttacagttcgatga

SEQ ID NO: 54915 - DNA, 15 bp, Homo sapiens
ttacagttcgatgaa

SEQ ID NO: 54916 - DNA, 15 bp, Homo sapiens
tacagttcgatgaac

SEQ ID NO: 54917 - DNA, 15 bp, Homo sapiens
acagttcgatgaact

SEQ ID NO: 54918 - DNA, 15 bp, Homo sapiens
cagttcgatgaacta

SEQ ID NO: 54919 - DNA, 15 bp, Homo sapiens
agttcgatgaactat

SEQ ID NO: 54920 - DNA, 15 bp, Homo sapiens
gttcgatgaactata

SEQ ID NO: 54921 - DNA, 15 bp, Homo sapiens
ttcgatgaactatac

SEQ ID NO: 54922 - DNA, 15 bp, Homo sapiens
tcgatgaactataca

SEQ ID NO: 54923 - DNA, 15 bp, Homo sapiens
cgatgaactatacat

SEQ ID NO: 54924 - DNA, 15 bp, Homo sapiens
gatgaactatacatc

SEQ ID NO: 54925 - DNA, 15 bp, Homo sapiens
atgaactatacatcc

SEQ ID NO: 54926 - DNA, 15 bp, Homo sapiens
tgaactatacatcca

SEQ ID NO: 54927 - DNA, 15 bp, Homo sapiens
gaactatacatccaa

SEQ ID NO: 54928 - DNA, 15 bp, Homo sapiens
aactatacatccaat

SEQ ID NO: 54929 - DNA, 15 bp, Homo sapiens
actatacatccaatt

SEQ ID NO: 54930 - DNA, 15 bp, Homo sapiens
ctatacatccaattt

SEQ ID NO: 54931 - DNA, 15 bp, Homo sapiens
tatacatccaattta

SEQ ID NO: 54932 - DNA, 15 bp, Homo sapiens
atacatccaatttac

SEQ ID NO: 54933 - DNA, 15 bp, Homo sapiens
tacatccaatttacc

SEQ ID NO: 54934 - DNA, 15 bp, Homo sapiens
acatccaatttacca

SEQ ID NO: 54935 - DNA, 15 bp, Homo sapiens
catccaatttaccag

SEQ ID NO: 54936 - DNA, 15 bp, Homo sapiens
atccaatttaccaga

SEQ ID NO: 54937 - DNA, 15 bp, Homo sapiens
tccaatttaccagag

SEQ ID NO: 54938 - DNA, 15 bp, Homo sapiens
ccaatttaccagagt

SEQ ID NO: 54939 - DNA, 15 bp, Homo sapiens
caatttaccagagtc

SEQ ID NO: 54940 - DNA, 15 bp, Homo sapiens
aatttaccagagtcc

SEQ ID NO: 54941 - DNA, 15 bp, Homo sapiens
atttaccagagtcct

SEQ ID NO: 54942 - DNA, 15 bp, Homo sapiens
tttaccagagtcctt

SEQ ID NO: 54943 - DNA, 15 bp, Homo sapiens
ttaccagagtccttt

SEQ ID NO: 54944 - DNA, 15 bp, Homo sapiens
taccagagtcctttc

SEQ ID NO: 54945 - DNA, 15 bp, Homo sapiens
accagagtcctttca

SEQ ID NO: 54946 - DNA, 15 bp, Homo sapiens
ccagagtcctttcac

SEQ ID NO: 54947 - DNA, 15 bp, Homo sapiens
cagagtcctttcaca

SEQ ID NO: 54948 - DNA, 15 bp, Homo sapiens
agagtcctttcacag

SEQ ID NO: 54949 - DNA, 15 bp, Homo sapiens
gagtcctttcacagt

SEQ ID NO: 54950 - DNA, 15 bp, Homo sapiens
agtcctttcacagtt

SEQ ID NO: 54951 - DNA, 15 bp, Homo sapiens
gtcctttcacagtta

SEQ ID NO: 54952 - DNA, 15 bp, Homo sapiens
tcctttcacagttag

SEQ ID NO: 54953 - DNA, 15 bp, Homo sapiens
cctttcacagttagt

SEQ ID NO: 54954 - DNA, 15 bp, Homo sapiens
ctttcacagttagtt

SEQ ID NO: 54955 - DNA, 15 bp, Homo sapiens
tttcacagttagttc

SEQ ID NO: 54956 - DNA, 15 bp, Homo sapiens
ttcacagttagttcc

SEQ ID NO: 54957 - DNA, 15 bp, Homo sapiens
tcacagttagttcca

SEQ ID NO: 54958 - DNA, 15 bp, Homo sapiens
cacagttagttccag

SEQ ID NO: 54959 - DNA, 15 bp, Homo sapiens
acagttagttccagt

SEQ ID NO: 54960 - DNA, 15 bp, Homo sapiens
cagttagttccagtt

SEQ ID NO: 54961 - DNA, 15 bp, Homo sapiens
agttagttccagttt

SEQ ID NO: 54962 - DNA, 15 bp, Homo sapiens
gttagttccagtttt

SEQ ID NO: 54963 - DNA, 15 bp, Homo sapiens
ttagttccagtttta

SEQ ID NO: 54964 - DNA, 15 bp, Homo sapiens
tagttccagttttag

SEQ ID NO: 54965 - DNA, 15 bp, Homo sapiens
agttccagttttagc

SEQ ID NO: 54966 - DNA, 15 bp, Homo sapiens
gttccagttttagca

SEQ ID NO: 54967 - DNA, 15 bp, Homo sapiens
ttccagttttagcat

SEQ ID NO: 54968 - DNA, 15 bp, Homo sapiens
tccagttttagcatc

SEQ ID NO: 54969 - DNA, 15 bp, Homo sapiens
ccagttttagcatcc

SEQ ID NO: 54970 - DNA, 15 bp, Homo sapiens
cagttttagcatcct

SEQ ID NO: 54971 - DNA, 15 bp, Homo sapiens
agttttagcatcctg

SEQ ID NO: 54972 - DNA, 15 bp, Homo sapiens
gttttagcatcctgc

SEQ ID NO: 54973 - DNA, 15 bp, Homo sapiens
ttttagcatcctgcc

SEQ ID NO: 54974 - DNA, 15 bp, Homo sapiens
tttagcatcctgccc

SEQ ID NO: 54975 - DNA, 15 bp, Homo sapiens
ttagcatcctgccct

SEQ ID NO: 54976 - DNA, 15 bp, Homo sapiens
tagcatcctgccctt

SEQ ID NO: 54977 - DNA, 15 bp, Homo sapiens
agcatcctgccctta

SEQ ID NO: 54978 - DNA, 15 bp, Homo sapiens
gcatcctgcccttac

SEQ ID NO: 54979 - DNA, 15 bp, Homo sapiens
catcctgcccttact

SEQ ID NO: 54980 - DNA, 15 bp, Homo sapiens
atcctgcccttactt

SEQ ID NO: 54981 - DNA, 15 bp, Homo sapiens
tcctgcccttacttg

SEQ ID NO: 54982 - DNA, 15 bp, Homo sapiens
cctgcccttacttgg

SEQ ID NO: 54983 - DNA, 15 bp, Homo sapiens
ctgcccttacttggg

SEQ ID NO: 54984 - DNA, 15 bp, Homo sapiens
tgcccttacttgggc

SEQ ID NO: 54985 - DNA, 15 bp, Homo sapiens
gcccttacttgggct

SEQ ID NO: 54986 - DNA, 15 bp, Homo sapiens
cccttacttgggctt

SEQ ID NO: 54987 - DNA, 15 bp, Homo sapiens
ccttacttgggcttt

SEQ ID NO: 54988 - DNA, 15 bp, Homo sapiens
cttacttgggctttt

SEQ ID NO: 54989 - DNA, 15 bp, Homo sapiens
ttacttgggcttttc

SEQ ID NO: 54990 - DNA, 15 bp, Homo sapiens
tacttgggcttttct

SEQ ID NO: 54991 - DNA, 15 bp, Homo sapiens
acttgggcttttctg

SEQ ID NO: 54992 - DNA, 15 bp, Homo sapiens
cttgggcttttctga

SEQ ID NO: 54993 - DNA, 15 bp, Homo sapiens
ttgggcttttctgaa

SEQ ID NO: 54994 - DNA, 15 bp, Homo sapiens
tgggcttttctgaat

SEQ ID NO: 54995 - DNA, 15 bp, Homo sapiens
gggcttttctgaatg

SEQ ID NO: 54996 - DNA, 15 bp, Homo sapiens
ggcttttctgaatga

SEQ ID NO: 54997 - DNA, 15 bp, Homo sapiens
gcttttctgaatgag

SEQ ID NO: 54998 - DNA, 15 bp, Homo sapiens
cttttctgaatgagc

SEQ ID NO: 54999 - DNA, 15 bp, Homo sapiens
ttttctgaatgagca

SEQ ID NO: 55000 - DNA, 15 bp, Homo sapiens
tttctgaatgagcaa

SEQ ID NO: 55001 - DNA, 15 bp, Homo sapiens
ttctgaatgagcaat

SEQ ID NO: 55002 - DNA, 15 bp, Homo sapiens
tctgaatgagcaatt

SEQ ID NO: 55003 - DNA, 15 bp, Homo sapiens
ctgaatgagcaatta

SEQ ID NO: 55004 - DNA, 15 bp, Homo sapiens
tgaatgagcaattaa

SEQ ID NO: 55005 - DNA, 15 bp, Homo sapiens
gaatgagcaattaaa

SEQ ID NO: 55006 - DNA, 15 bp, Homo sapiens
aatgagcaattaaac

SEQ ID NO: 55007 - DNA, 15 bp, Homo sapiens
atgagcaattaaaca

SEQ ID NO: 55008 - DNA, 15 bp, Homo sapiens
tgagcaattaaacat

SEQ ID NO: 55009 - DNA, 15 bp, Homo sapiens
gagcaattaaacatc

SEQ ID NO: 55010 - DNA, 15 bp, Homo sapiens
agcaattaaacatca

SEQ ID NO: 55011 - DNA, 15 bp, Homo sapiens
gcaattaaacatcag

SEQ ID NO: 55012 - DNA, 15 bp, Homo sapiens
caattaaacatcagg

SEQ ID NO: 55013 - DNA, 15 bp, Homo sapiens
aattaaacatcaggg

SEQ ID NO: 55014 - DNA, 15 bp, Homo sapiens
attaaacatcagggt

SEQ ID NO: 55015 - DNA, 15 bp, Homo sapiens
ttaaacatcagggtt

SEQ ID NO: 55016 - DNA, 15 bp, Homo sapiens
taaacatcagggttt

SEQ ID NO: 55017 - DNA, 15 bp, Homo sapiens
aaacatcagggtttt

SEQ ID NO: 55018 - DNA, 15 bp, Homo sapiens
aacatcagggttttc

SEQ ID NO: 55019 - DNA, 15 bp, Homo sapiens
acatcagggttttca

SEQ ID NO: 55020 - DNA, 15 bp, Homo sapiens
catcagggttttcag

SEQ ID NO: 55021 - DNA, 15 bp, Homo sapiens
atcagggttttcaga

SEQ ID NO: 55022 - DNA, 15 bp, Homo sapiens
tcagggttttcagat

SEQ ID NO: 55023 - DNA, 15 bp, Homo sapiens
cagggttttcagatt

SEQ ID NO: 55024 - DNA, 15 bp, Homo sapiens
agggttttcagattg

SEQ ID NO: 55025 - DNA, 15 bp, Homo sapiens
gggttttcagattga

SEQ ID NO: 55026 - DNA, 15 bp, Homo sapiens
ggttttcagattgag

SEQ ID NO: 55027 - DNA, 15 bp, Homo sapiens
gttttcagattgagc

SEQ ID NO: 55028 - DNA, 15 bp, Homo sapiens
ttttcagattgagcc

SEQ ID NO: 55029 - DNA, 15 bp, Homo sapiens
tttcagattgagccc

SEQ ID NO: 55030 - DNA, 15 bp, Homo sapiens
ttcagattgagccct

SEQ ID NO: 55031 - DNA, 15 bp, Homo sapiens
tcagattgagccctc

SEQ ID NO: 55032 - DNA, 15 bp, Homo sapiens
cagattgagccctct

SEQ ID NO: 55033 - DNA, 15 bp, Homo sapiens
agattgagccctctg

SEQ ID NO: 55034 - DNA, 15 bp, Homo sapiens
gattgagccctctgt

SEQ ID NO: 55035 - DNA, 15 bp, Homo sapiens
attgagccctctgtg

SEQ ID NO: 55036 - DNA, 15 bp, Homo sapiens
ttgagccctctgtgc

SEQ ID NO: 55037 - DNA, 15 bp, Homo sapiens
tgagccctctgtgca

SEQ ID NO: 55038 - DNA, 15 bp, Homo sapiens
gagccctctgtgcaa

SEQ ID NO: 55039 - DNA, 15 bp, Homo sapiens
agccctctgtgcaaa

SEQ ID NO: 55040 - DNA, 15 bp, Homo sapiens
gccctctgtgcaaag

SEQ ID NO: 55041 - DNA, 15 bp, Homo sapiens
ccctctgtgcaaagg

SEQ ID NO: 55042 - DNA, 15 bp, Homo sapiens
cctctgtgcaaaggg

SEQ ID NO: 55043 - DNA, 15 bp, Homo sapiens
ctctgtgcaaaggga

SEQ ID NO: 55044 - DNA, 15 bp, Homo sapiens
tctgtgcaaagggat

SEQ ID NO: 55045 - DNA, 15 bp, Homo sapiens
ctgtgcaaagggata

SEQ ID NO: 55046 - DNA, 15 bp, Homo sapiens
tgtgcaaagggataa

SEQ ID NO: 55047 - DNA, 15 bp, Homo sapiens
gtgcaaagggataag

SEQ ID NO: 55048 - DNA, 15 bp, Homo sapiens
tgcaaagggataaga

SEQ ID NO: 55049 - DNA, 15 bp, Homo sapiens
gcaaagggataagaa

SEQ ID NO: 55050 - DNA, 15 bp, Homo sapiens
caaagggataagaat

SEQ ID NO: 55051 - DNA, 15 bp, Homo sapiens
aaagggataagaatg

SEQ ID NO: 55052 - DNA, 15 bp, Homo sapiens
aagggataagaatga

SEQ ID NO: 55053 - DNA, 15 bp, Homo sapiens
agggataagaatgat

SEQ ID NO: 55054 - DNA, 15 bp, Homo sapiens
gggataagaatgatt

SEQ ID NO: 55055 - DNA, 15 bp, Homo sapiens
ggataagaatgattc

SEQ ID NO: 55056 - DNA, 15 bp, Homo sapiens
gataagaatgattca

SEQ ID NO: 55057 - DNA, 15 bp, Homo sapiens
ataagaatgattcac

SEQ ID NO: 55058 - DNA, 15 bp, Homo sapiens
taagaatgattcacg

SEQ ID NO: 55059 - DNA, 15 bp, Homo sapiens
aagaatgattcacgc

SEQ ID NO: 55060 - DNA, 15 bp, Homo sapiens
agaatgattcacgct

SEQ ID NO: 55061 - DNA, 15 bp, Homo sapiens
gaatgattcacgcta

SEQ ID NO: 55062 - DNA, 15 bp, Homo sapiens
aatgattcacgctag

SEQ ID NO: 55063 - DNA, 15 bp, Homo sapiens
atgattcacgctagg

SEQ ID NO: 55064 - DNA, 15 bp, Homo sapiens
tgattcacgctaggt

SEQ ID NO: 55065 - DNA, 15 bp, Homo sapiens
gattcacgctaggtt

SEQ ID NO: 55066 - DNA, 15 bp, Homo sapiens
attcacgctaggttc

SEQ ID NO: 55067 - DNA, 15 bp, Homo sapiens
ttcacgctaggttct

SEQ ID NO: 55068 - DNA, 15 bp, Homo sapiens
tcacgctaggttctg

SEQ ID NO: 55069 - DNA, 15 bp, Homo sapiens
cacgctaggttctgc

SEQ ID NO: 55070 - DNA, 15 bp, Homo sapiens
acgctaggttctgcc

SEQ ID NO: 55071 - DNA, 15 bp, Homo sapiens
cgctaggttctgcct

SEQ ID NO: 55072 - DNA, 15 bp, Homo sapiens
gctaggttctgcctt

SEQ ID NO: 55073 - DNA, 15 bp, Homo sapiens
ctaggttctgccttc

SEQ ID NO: 55074 - DNA, 15 bp, Homo sapiens
taggttctgccttcc

SEQ ID NO: 55075 - DNA, 15 bp, Homo sapiens
aggttctgccttcca

SEQ ID NO: 55076 - DNA, 15 bp, Homo sapiens
ggttctgccttccaa

SEQ ID NO: 55077 - DNA, 15 bp, Homo sapiens
gttctgccttccaag

SEQ ID NO: 55078 - DNA, 15 bp, Homo sapiens
ttctgccttccaaga

SEQ ID NO: 55079 - DNA, 15 bp, Homo sapiens
tctgccttccaagag

SEQ ID NO: 55080 - DNA, 15 bp, Homo sapiens
ctgccttccaagagt

SEQ ID NO: 55081 - DNA, 15 bp, Homo sapiens
tgccttccaagagtt

SEQ ID NO: 55082 - DNA, 15 bp, Homo sapiens
gccttccaagagttc

SEQ ID NO: 55083 - DNA, 15 bp, Homo sapiens
ccttccaagagttca

SEQ ID NO: 55084 - DNA, 15 bp, Homo sapiens
cttccaagagttcat

SEQ ID NO: 55085 - DNA, 15 bp, Homo sapiens
ttccaagagttcata

SEQ ID NO: 55086 - DNA, 15 bp, Homo sapiens
tccaagagttcatag

SEQ ID NO: 55087 - DNA, 15 bp, Homo sapiens
ccaagagttcatagg

SEQ ID NO: 55088 - DNA, 15 bp, Homo sapiens
caagagttcataggt

SEQ ID NO: 55089 - DNA, 15 bp, Homo sapiens
aagagttcataggtg

SEQ ID NO: 55090 - DNA, 15 bp, Homo sapiens
agagttcataggtgg

SEQ ID NO: 55091 - DNA, 15 bp, Homo sapiens
gagttcataggtggg

SEQ ID NO: 55092 - DNA, 15 bp, Homo sapiens
agttcataggtggga

SEQ ID NO: 55093 - DNA, 15 bp, Homo sapiens
gttcataggtgggat

SEQ ID NO: 55094 - DNA, 15 bp, Homo sapiens
ttcataggtgggatt

SEQ ID NO: 55095 - DNA, 15 bp, Homo sapiens
tcataggtgggattt

SEQ ID NO: 55096 - DNA, 15 bp, Homo sapiens
cataggtgggattta

SEQ ID NO: 55097 - DNA, 15 bp, Homo sapiens
ataggtgggatttaa

SEQ ID NO: 55098 - DNA, 15 bp, Homo sapiens
taggtgggatttaaa

SEQ ID NO: 55099 - DNA, 15 bp, Homo sapiens
aggtgggatttaaat

SEQ ID NO: 55100 - DNA, 15 bp, Homo sapiens
ggtgggatttaaata

SEQ ID NO: 55101 - DNA, 15 bp, Homo sapiens
gtgggatttaaatag

SEQ ID NO: 55102 - DNA, 15 bp, Homo sapiens
tgggatttaaataga

SEQ ID NO: 55103 - DNA, 15 bp, Homo sapiens
gggatttaaatagat

SEQ ID NO: 55104 - DNA, 15 bp, Homo sapiens
ggatttaaatagata

SEQ ID NO: 55105 - DNA, 15 bp, Homo sapiens
gatttaaatagataa

SEQ ID NO: 55106 - DNA, 15 bp, Homo sapiens
atttaaatagataat

SEQ ID NO: 55107 - DNA, 15 bp, Homo sapiens
tttaaatagataatt

SEQ ID NO: 55108 - DNA, 15 bp, Homo sapiens
ttaaatagataattg

SEQ ID NO: 55109 - DNA, 15 bp, Homo sapiens
taaatagataattgt

SEQ ID NO: 55110 - DNA, 15 bp, Homo sapiens
aaatagataattgtc

SEQ ID NO: 55111 - DNA, 15 bp, Homo sapiens
aatagataattgtca

SEQ ID NO: 55112 - DNA, 15 bp, Homo sapiens
atagataattgtcac

SEQ ID NO: 55113 - DNA, 15 bp, Homo sapiens
tagataattgtcacc

SEQ ID NO: 55114 - DNA, 15 bp, Homo sapiens
agataattgtcacca

SEQ ID NO: 55115 - DNA, 15 bp, Homo sapiens
gataattgtcaccaa

SEQ ID NO: 55116 - DNA, 15 bp, Homo sapiens
ataattgtcaccaag

SEQ ID NO: 55117 - DNA, 15 bp, Homo sapiens
taattgtcaccaagt

SEQ ID NO: 55118 - DNA, 15 bp, Homo sapiens
aattgtcaccaagtt

SEQ ID NO: 55119 - DNA, 15 bp, Homo sapiens
attgtcaccaagtta

SEQ ID NO: 55120 - DNA, 15 bp, Homo sapiens
ttgtcaccaagttat

SEQ ID NO: 55121 - DNA, 15 bp, Homo sapiens
tgtcaccaagttata

SEQ ID NO: 55122 - DNA, 15 bp, Homo sapiens
gtcaccaagttataa

SEQ ID NO: 55123 - DNA, 15 bp, Homo sapiens
tcaccaagttataaa

SEQ ID NO: 55124 - DNA, 15 bp, Homo sapiens
caccaagttataaaa

SEQ ID NO: 55125 - DNA, 15 bp, Homo sapiens
accaagttataaaat

SEQ ID NO: 55126 - DNA, 15 bp, Homo sapiens
ccaagttataaaatt

SEQ ID NO: 55127 - DNA, 15 bp, Homo sapiens
caagttataaaattt

SEQ ID NO: 55128 - DNA, 15 bp, Homo sapiens
aagttataaaattta

SEQ ID NO: 55129 - DNA, 15 bp, Homo sapiens
agttataaaatttag

SEQ ID NO: 55130 - DNA, 15 bp, Homo sapiens
gttataaaatttagt

SEQ ID NO: 55131 - DNA, 15 bp, Homo sapiens
ttataaaatttagtc

SEQ ID NO: 55132 - DNA, 15 bp, Homo sapiens
tataaaatttagtcc

SEQ ID NO: 55133 - DNA, 15 bp, Homo sapiens
ataaaatttagtccc

SEQ ID NO: 55134 - DNA, 15 bp, Homo sapiens
taaaatttagtccct

SEQ ID NO: 55135 - DNA, 15 bp, Homo sapiens
aaaatttagtccctg

SEQ ID NO: 55136 - DNA, 15 bp, Homo sapiens
aaatttagtccctgt

SEQ ID NO: 55137 - DNA, 15 bp, Homo sapiens
aatttagtccctgtt

SEQ ID NO: 55138 - DNA, 15 bp, Homo sapiens
atttagtccctgttt

SEQ ID NO: 55139 - DNA, 15 bp, Homo sapiens
tttagtccctgtttc

SEQ ID NO: 55140 - DNA, 15 bp, Homo sapiens
ttagtccctgtttcc

SEQ ID NO: 55141 - DNA, 15 bp, Homo sapiens
tagtccctgtttcca

SEQ ID NO: 55142 - DNA, 15 bp, Homo sapiens
agtccctgtttccat

SEQ ID NO: 55143 - DNA, 15 bp, Homo sapiens
gtccctgtttccata

SEQ ID NO: 55144 - DNA, 15 bp, Homo sapiens
tccctgtttccataa

SEQ ID NO: 55145 - DNA, 15 bp, Homo sapiens
ccctgtttccataag

SEQ ID NO: 55146 - DNA, 15 bp, Homo sapiens
cctgtttccataaga

SEQ ID NO: 55147 - DNA, 15 bp, Homo sapiens
ctgtttccataagag

SEQ ID NO: 55148 - DNA, 15 bp, Homo sapiens
tgtttccataagaga

SEQ ID NO: 55149 - DNA, 15 bp, Homo sapiens
gtttccataagagaa

SEQ ID NO: 55150 - DNA, 15 bp, Homo sapiens
tttccataagagaag

SEQ ID NO: 55151 - DNA, 15 bp, Homo sapiens
ttccataagagaagg

SEQ ID NO: 55152 - DNA, 15 bp, Homo sapiens
tccataagagaaggg

SEQ ID NO: 55153 - DNA, 15 bp, Homo sapiens
ccataagagaagggt

SEQ ID NO: 55154 - DNA, 15 bp, Homo sapiens
cataagagaagggtt

SEQ ID NO: 55155 - DNA, 15 bp, Homo sapiens
ataagagaagggttg

SEQ ID NO: 55156 - DNA, 15 bp, Homo sapiens
taagagaagggttgc

SEQ ID NO: 55157 - DNA, 15 bp, Homo sapiens
aagagaagggttgcg

SEQ ID NO: 55158 - DNA, 15 bp, Homo sapiens
agagaagggttgcgc

SEQ ID NO: 55159 - DNA, 15 bp, Homo sapiens
gagaagggttgcgca

SEQ ID NO: 55160 - DNA, 15 bp, Homo sapiens
agaagggttgcgcag

SEQ ID NO: 55161 - DNA, 15 bp, Homo sapiens
gaagggttgcgcagt

SEQ ID NO: 55162 - DNA, 15 bp, Homo sapiens
aagggttgcgcagtg

SEQ ID NO: 55163 - DNA, 15 bp, Homo sapiens
agggttgcgcagtgg

SEQ ID NO: 55164 - DNA, 15 bp, Homo sapiens
gggttgcgcagtggc

SEQ ID NO: 55165 - DNA, 15 bp, Homo sapiens
ggttgcgcagtggct

SEQ ID NO: 55166 - DNA, 15 bp, Homo sapiens
gttgcgcagtggctg

SEQ ID NO: 55167 - DNA, 15 bp, Homo sapiens
ttgcgcagtggctgg

SEQ ID NO: 55168 - DNA, 15 bp, Homo sapiens
tgcgcagtggctggt

SEQ ID NO: 55169 - DNA, 15 bp, Homo sapiens
gcgcagtggctggtc

SEQ ID NO: 55170 - DNA, 15 bp, Homo sapiens
cgcagtggctggtcc

SEQ ID NO: 55171 - DNA, 15 bp, Homo sapiens
gcagtggctggtccc

SEQ ID NO: 55172 - DNA, 15 bp, Homo sapiens
cagtggctggtccct

SEQ ID NO: 55173 - DNA, 15 bp, Homo sapiens
agtggctggtccctt

SEQ ID NO: 55174 - DNA, 15 bp, Homo sapiens
gtggctggtcccttt

SEQ ID NO: 55175 - DNA, 15 bp, Homo sapiens
tggctggtccctttt

SEQ ID NO: 55176 - DNA, 15 bp, Homo sapiens
ggctggtccctttta

SEQ ID NO: 55177 - DNA, 15 bp, Homo sapiens
gctggtcccttttat

SEQ ID NO: 55178 - DNA, 15 bp, Homo sapiens
ctggtcccttttata

SEQ ID NO: 55179 - DNA, 15 bp, Homo sapiens
tggtcccttttatat

SEQ ID NO: 55180 - DNA, 15 bp, Homo sapiens
ggtcccttttatata

SEQ ID NO: 55181 - DNA, 15 bp, Homo sapiens
gtcccttttatatat

SEQ ID NO: 55182 - DNA, 15 bp, Homo sapiens
tcccttttatatata

SEQ ID NO: 55183 - DNA, 15 bp, Homo sapiens
cccttttatatataa

SEQ ID NO: 55184 - DNA, 15 bp, Homo sapiens
ccttttatatataaa

SEQ ID NO: 55185 - DNA, 15 bp, Homo sapiens
cttttatatataaat

SEQ ID NO: 55186 - DNA, 15 bp, Homo sapiens
ttttatatataaatc

SEQ ID NO: 55187 - DNA, 15 bp, Homo sapiens
tttatatataaatca

SEQ ID NO: 55188 - DNA, 15 bp, Homo sapiens
ttatatataaatcat

SEQ ID NO: 55189 - DNA, 15 bp, Homo sapiens
tatatataaatcatc

SEQ ID NO: 55190 - DNA, 15 bp, Homo sapiens
atatataaatcatct

SEQ ID NO: 55191 - DNA, 15 bp, Homo sapiens
tatataaatcatctc

SEQ ID NO: 55192 - DNA, 15 bp, Homo sapiens
atataaatcatctct

SEQ ID NO: 55193 - DNA, 15 bp, Homo sapiens
tataaatcatctctt

SEQ ID NO: 55194 - DNA, 15 bp, Homo sapiens
ataaatcatctcttt

SEQ ID NO: 55195 - DNA, 15 bp, Homo sapiens
taaatcatctcttta

SEQ ID NO: 55196 - DNA, 15 bp, Homo sapiens
aaatcatctctttag

SEQ ID NO: 55197 - DNA, 15 bp, Homo sapiens
aatcatctctttagc

SEQ ID NO: 55198 - DNA, 15 bp, Homo sapiens
atcatctctttagcc

SEQ ID NO: 55199 - DNA, 15 bp, Homo sapiens
tcatctctttagccc

SEQ ID NO: 55200 - DNA, 15 bp, Homo sapiens
catctctttagccct

SEQ ID NO: 55201 - DNA, 15 bp, Homo sapiens
atctctttagccctc

SEQ ID NO: 55202 - DNA, 15 bp, Homo sapiens
tctctttagccctca

SEQ ID NO: 55203 - DNA, 15 bp, Homo sapiens
ctctttagccctcat

SEQ ID NO: 55204 - DNA, 15 bp, Homo sapiens
tctttagccctcatc

SEQ ID NO: 55205 - DNA, 15 bp, Homo sapiens
ctttagccctcatct

SEQ ID NO: 55206 - DNA, 15 bp, Homo sapiens
tttagccctcatctt

SEQ ID NO: 55207 - DNA, 15 bp, Homo sapiens
ttagccctcatcttc

SEQ ID NO: 55208 - DNA, 15 bp, Homo sapiens
tagccctcatcttcc

SEQ ID NO: 55209 - DNA, 15 bp, Homo sapiens
agccctcatcttcct

SEQ ID NO: 55210 - DNA, 15 bp, Homo sapiens
gccctcatcttcctc

SEQ ID NO: 55211 - DNA, 15 bp, Homo sapiens
ccctcatcttcctca

SEQ ID NO: 55212 - DNA, 15 bp, Homo sapiens
cctcatcttcctcac

SEQ ID NO: 55213 - DNA, 15 bp, Homo sapiens
ctcatcttcctcacc

SEQ ID NO: 55214 - DNA, 15 bp, Homo sapiens
tcatcttcctcaccc

SEQ ID NO: 55215 - DNA, 15 bp, Homo sapiens
catcttcctcacccc

SEQ ID NO: 55216 - DNA, 15 bp, Homo sapiens
atcttcctcaccccg

SEQ ID NO: 55217 - DNA, 15 bp, Homo sapiens
tcttcctcaccccgg

SEQ ID NO: 55218 - DNA, 15 bp, Homo sapiens
cttcctcaccccggg

SEQ ID NO: 55219 - DNA, 15 bp, Homo sapiens
ttcctcaccccgggt

SEQ ID NO: 55220 - DNA, 15 bp, Homo sapiens
tcctcaccccgggtt

SEQ ID NO: 55221 - DNA, 15 bp, Homo sapiens
cctcaccccgggttc

SEQ ID NO: 55222 - DNA, 15 bp, Homo sapiens
ctcaccccgggttct

SEQ ID NO: 55223 - DNA, 15 bp, Homo sapiens
tcaccccgggttctt

SEQ ID NO: 55224 - DNA, 15 bp, Homo sapiens
caccccgggttcttc

SEQ ID NO: 55225 - DNA, 15 bp, Homo sapiens
accccgggttcttcc

SEQ ID NO: 55226 - DNA, 15 bp, Homo sapiens
ccccgggttcttccc

SEQ ID NO: 55227 - DNA, 15 bp, Homo sapiens
cccgggttcttcccc

SEQ ID NO: 55228 - DNA, 15 bp, Homo sapiens
ccgggttcttcccca

SEQ ID NO: 55229 - DNA, 15 bp, Homo sapiens
cgggttcttccccat

SEQ ID NO: 55230 - DNA, 15 bp, Homo sapiens
gggttcttccccatt

SEQ ID NO: 55231 - DNA, 15 bp, Homo sapiens
ggttcttccccattt

SEQ ID NO: 55232 - DNA, 15 bp, Homo sapiens
gttcttccccatttc

SEQ ID NO: 55233 - DNA, 15 bp, Homo sapiens
ttcttccccatttca

SEQ ID NO: 55234 - DNA, 15 bp, Homo sapiens
tcttccccatttcat

SEQ ID NO: 55235 - DNA, 15 bp, Homo sapiens
cttccccatttcata

SEQ ID NO: 55236 - DNA, 15 bp, Homo sapiens
ttccccatttcatag

SEQ ID NO: 55237 - DNA, 15 bp, Homo sapiens
tccccatttcataga

SEQ ID NO: 55238 - DNA, 15 bp, Homo sapiens
ccccatttcatagat

SEQ ID NO: 55239 - DNA, 15 bp, Homo sapiens
cccatttcatagatt

SEQ ID NO: 55240 - DNA, 15 bp, Homo sapiens
ccatttcatagattg

SEQ ID NO: 55241 - DNA, 15 bp, Homo sapiens
catttcatagattgg

SEQ ID NO: 55242 - DNA, 15 bp, Homo sapiens
atttcatagattggg

SEQ ID NO: 55243 - DNA, 15 bp, Homo sapiens
tttcatagattggga

SEQ ID NO: 55244 - DNA, 15 bp, Homo sapiens
ttcatagattgggaa

SEQ ID NO: 55245 - DNA, 15 bp, Homo sapiens
tcatagattgggaaa

SEQ ID NO: 55246 - DNA, 15 bp, Homo sapiens
catagattgggaaag

SEQ ID NO: 55247 - DNA, 15 bp, Homo sapiens
atagattgggaaagt

SEQ ID NO: 55248 - DNA, 15 bp, Homo sapiens
tagattgggaaagtg

SEQ ID NO: 55249 - DNA, 15 bp, Homo sapiens
agattgggaaagtga

SEQ ID NO: 55250 - DNA, 15 bp, Homo sapiens
gattgggaaagtgag

SEQ ID NO: 55251 - DNA, 15 bp, Homo sapiens
attgggaaagtgagg

SEQ ID NO: 55252 - DNA, 15 bp, Homo sapiens
ttgggaaagtgaggt

SEQ ID NO: 55253 - DNA, 15 bp, Homo sapiens
tgggaaagtgaggtg

SEQ ID NO: 55254 - DNA, 15 bp, Homo sapiens
gggaaagtgaggtga

SEQ ID NO: 55255 - DNA, 15 bp, Homo sapiens
ggaaagtgaggtgaa

SEQ ID NO: 55256 - DNA, 15 bp, Homo sapiens
gaaagtgaggtgaaa

SEQ ID NO: 55257 - DNA, 15 bp, Homo sapiens
aaagtgaggtgaaat

SEQ ID NO: 55258 - DNA, 15 bp, Homo sapiens
aagtgaggtgaaatc

SEQ ID NO: 55259 - DNA, 15 bp, Homo sapiens
agtgaggtgaaatca

SEQ ID NO: 55260 - DNA, 15 bp, Homo sapiens
gtgaggtgaaatcac

SEQ ID NO: 55261 - DNA, 15 bp, Homo sapiens
tgaggtgaaatcact

SEQ ID NO: 55262 - DNA, 15 bp, Homo sapiens
gaggtgaaatcactt

SEQ ID NO: 55263 - DNA, 15 bp, Homo sapiens
aggtgaaatcacttc

SEQ ID NO: 55264 - DNA, 15 bp, Homo sapiens
ggtgaaatcacttcc

SEQ ID NO: 55265 - DNA, 15 bp, Homo sapiens
gtgaaatcacttccc

SEQ ID NO: 55266 - DNA, 15 bp, Homo sapiens
tgaaatcacttccct

SEQ ID NO: 55267 - DNA, 15 bp, Homo sapiens
gaaatcacttccctg

SEQ ID NO: 55268 - DNA, 15 bp, Homo sapiens
aaatcacttccctgg

SEQ ID NO: 55269 - DNA, 15 bp, Homo sapiens
aatcacttccctggg

SEQ ID NO: 55270 - DNA, 15 bp, Homo sapiens
atcacttccctggga

SEQ ID NO: 55271 - DNA, 15 bp, Homo sapiens
tcacttccctgggat

SEQ ID NO: 55272 - DNA, 15 bp, Homo sapiens
cacttccctgggatc

SEQ ID NO: 55273 - DNA, 15 bp, Homo sapiens
acttccctgggatcc

SEQ ID NO: 55274 - DNA, 15 bp, Homo sapiens
cttccctgggatccc

SEQ ID NO: 55275 - DNA, 15 bp, Homo sapiens
ttccctgggatccca

SEQ ID NO: 55276 - DNA, 15 bp, Homo sapiens
tccctgggatcccat

SEQ ID NO: 55277 - DNA, 15 bp, Homo sapiens
ccctgggatcccata

SEQ ID NO: 55278 - DNA, 15 bp, Homo sapiens
cctgggatcccatag

SEQ ID NO: 55279 - DNA, 15 bp, Homo sapiens
ctgggatcccatagg

SEQ ID NO: 55280 - DNA, 15 bp, Homo sapiens
tgggatcccatagga

SEQ ID NO: 55281 - DNA, 15 bp, Homo sapiens
gggatcccataggaa

SEQ ID NO: 55282 - DNA, 15 bp, Homo sapiens
ggatcccataggaag

SEQ ID NO: 55283 - DNA, 15 bp, Homo sapiens
gatcccataggaagg

SEQ ID NO: 55284 - DNA, 15 bp, Homo sapiens
atcccataggaaggc

SEQ ID NO: 55285 - DNA, 15 bp, Homo sapiens
tcccataggaaggca

SEQ ID NO: 55286 - DNA, 15 bp, Homo sapiens
cccataggaaggcat

SEQ ID NO: 55287 - DNA, 15 bp, Homo sapiens
ccataggaaggcatt

SEQ ID NO: 55288 - DNA, 15 bp, Homo sapiens
cataggaaggcattg

SEQ ID NO: 55289 - DNA, 15 bp, Homo sapiens
ataggaaggcattgt

SEQ ID NO: 55290 - DNA, 15 bp, Homo sapiens
taggaaggcattgtg

SEQ ID NO: 55291 - DNA, 15 bp, Homo sapiens
aggaaggcattgtgt

SEQ ID NO: 55292 - DNA, 15 bp, Homo sapiens
ggaaggcattgtgtt

SEQ ID NO: 55293 - DNA, 15 bp, Homo sapiens
gaaggcattgtgttt

SEQ ID NO: 55294 - DNA, 15 bp, Homo sapiens
aaggcattgtgtttt

SEQ ID NO: 55295 - DNA, 15 bp, Homo sapiens
aggcattgtgttttc

SEQ ID NO: 55296 - DNA, 15 bp, Homo sapiens
ggcattgtgttttca

SEQ ID NO: 55297 - DNA, 15 bp, Homo sapiens
gcattgtgttttcat

SEQ ID NO: 55298 - DNA, 15 bp, Homo sapiens
cattgtgttttcata

SEQ ID NO: 55299 - DNA, 15 bp, Homo sapiens
attgtgttttcataa

SEQ ID NO: 55300 - DNA, 15 bp, Homo sapiens
ttgtgttttcataat

SEQ ID NO: 55301 - DNA, 15 bp, Homo sapiens
tgtgttttcataata

SEQ ID NO: 55302 - DNA, 15 bp, Homo sapiens
gtgttttcataatat

SEQ ID NO: 55303 - DNA, 15 bp, Homo sapiens
tgttttcataatata

SEQ ID NO: 55304 - DNA, 15 bp, Homo sapiens
gttttcataatatat

SEQ ID NO: 55305 - DNA, 15 bp, Homo sapiens
ttttcataatatatt

SEQ ID NO: 55306 - DNA, 15 bp, Homo sapiens
tttcataatatattc

SEQ ID NO: 55307 - DNA, 15 bp, Homo sapiens
ttcataatatattca

SEQ ID NO: 55308 - DNA, 15 bp, Homo sapiens
tcataatatattcac

SEQ ID NO: 55309 - DNA, 15 bp, Homo sapiens
cataatatattcaca

SEQ ID NO: 55310 - DNA, 15 bp, Homo sapiens
ataatatattcacat

SEQ ID NO: 55311 - DNA, 15 bp, Homo sapiens
taatatattcacatg

SEQ ID NO: 55312 - DNA, 15 bp, Homo sapiens
aatatattcacatga

SEQ ID NO: 55313 - DNA, 15 bp, Homo sapiens
atatattcacatgac

SEQ ID NO: 55314 - DNA, 15 bp, Homo sapiens
tatattcacatgact

SEQ ID NO: 55315 - DNA, 15 bp, Homo sapiens
atattcacatgactt

SEQ ID NO: 55316 - DNA, 15 bp, Homo sapiens
tattcacatgacttc

SEQ ID NO: 55317 - DNA, 15 bp, Homo sapiens
attcacatgacttca

SEQ ID NO: 55318 - DNA, 15 bp, Homo sapiens
ttcacatgacttcaa

SEQ ID NO: 55319 - DNA, 15 bp, Homo sapiens
tcacatgacttcaaa

SEQ ID NO: 55320 - DNA, 15 bp, Homo sapiens
cacatgacttcaaat

SEQ ID NO: 55321 - DNA, 15 bp, Homo sapiens
acatgacttcaaatt

SEQ ID NO: 55322 - DNA, 15 bp, Homo sapiens
catgacttcaaattc

SEQ ID NO: 55323 - DNA, 15 bp, Homo sapiens
atgacttcaaattca

SEQ ID NO: 55324 - DNA, 15 bp, Homo sapiens
tgacttcaaattcaa

SEQ ID NO: 55325 - DNA, 15 bp, Homo sapiens
gacttcaaattcaaa

SEQ ID NO: 55326 - DNA, 15 bp, Homo sapiens
acttcaaattcaaaa

SEQ ID NO: 55327 - DNA, 15 bp, Homo sapiens
cttcaaattcaaaaa

SEQ ID NO: 55328 - DNA, 15 bp, Homo sapiens
ttcaaattcaaaaag

SEQ ID NO: 55329 - DNA, 15 bp, Homo sapiens
tcaaattcaaaaagc

SEQ ID NO: 55330 - DNA, 15 bp, Homo sapiens
caaattcaaaaagca

SEQ ID NO: 55331 - DNA, 15 bp, Homo sapiens
aaattcaaaaagcac

SEQ ID NO: 55332 - DNA, 15 bp, Homo sapiens
aattcaaaaagcaca

SEQ ID NO: 55333 - DNA, 15 bp, Homo sapiens
attcaaaaagcacac

SEQ ID NO: 55334 - DNA, 15 bp, Homo sapiens
ttcaaaaagcacaca

SEQ ID NO: 55335 - DNA, 15 bp, Homo sapiens
tcaaaaagcacacaa

SEQ ID NO: 55336 - DNA, 15 bp, Homo sapiens
caaaaagcacacaat

SEQ ID NO: 55337 - DNA, 15 bp, Homo sapiens
aaaaagcacacaatg

SEQ ID NO: 55338 - DNA, 15 bp, Homo sapiens
aaaagcacacaatgg

SEQ ID NO: 55339 - DNA, 15 bp, Homo sapiens
aaagcacacaatggc

SEQ ID NO: 55340 - DNA, 15 bp, Homo sapiens
aagcacacaatggca

SEQ ID NO: 55341 - DNA, 15 bp, Homo sapiens
agcacacaatggcat

SEQ ID NO: 55342 - DNA, 15 bp, Homo sapiens
gcacacaatggcata

SEQ ID NO: 55343 - DNA, 15 bp, Homo sapiens
cacacaatggcatag

SEQ ID NO: 55344 - DNA, 15 bp, Homo sapiens
acacaatggcataga

SEQ ID NO: 55345 - DNA, 15 bp, Homo sapiens
cacaatggcatagaa

SEQ ID NO: 55346 - DNA, 15 bp, Homo sapiens
acaatggcatagaat

SEQ ID NO: 55347 - DNA, 15 bp, Homo sapiens
caatggcatagaatg

SEQ ID NO: 55348 - DNA, 15 bp, Homo sapiens
aatggcatagaatgg

SEQ ID NO: 55349 - DNA, 15 bp, Homo sapiens
atggcatagaatgga

SEQ ID NO: 55350 - DNA, 15 bp, Homo sapiens
tggcatagaatggaa

SEQ ID NO: 55351 - DNA, 15 bp, Homo sapiens
ggcatagaatggaaa

SEQ ID NO: 55352 - DNA, 15 bp, Homo sapiens
gcatagaatggaaag

SEQ ID NO: 55353 - DNA, 15 bp, Homo sapiens
catagaatggaaagg

SEQ ID NO: 55354 - DNA, 15 bp, Homo sapiens
atagaatggaaaggg

SEQ ID NO: 55355 - DNA, 15 bp, Homo sapiens
tagaatggaaagggt

SEQ ID NO: 55356 - DNA, 15 bp, Homo sapiens
agaatggaaagggtt

SEQ ID NO: 55357 - DNA, 15 bp, Homo sapiens
gaatggaaagggttt

SEQ ID NO: 55358 - DNA, 15 bp, Homo sapiens
aatggaaagggtttg

SEQ ID NO: 55359 - DNA, 15 bp, Homo sapiens
atggaaagggtttgg

SEQ ID NO: 55360 - DNA, 15 bp, Homo sapiens
tggaaagggtttggg

SEQ ID NO: 55361 - DNA, 15 bp, Homo sapiens
ggaaagggtttgggc

SEQ ID NO: 55362 - DNA, 15 bp, Homo sapiens
gaaagggtttgggcc

SEQ ID NO: 55363 - DNA, 15 bp, Homo sapiens
aaagggtttgggcca

SEQ ID NO: 55364 - DNA, 15 bp, Homo sapiens
aagggtttgggccag

SEQ ID NO: 55365 - DNA, 15 bp, Homo sapiens
agggtttgggccagt

SEQ ID NO: 55366 - DNA, 15 bp, Homo sapiens
gggtttgggccagtc

SEQ ID NO: 55367 - DNA, 15 bp, Homo sapiens
ggtttgggccagtca

SEQ ID NO: 55368 - DNA, 15 bp, Homo sapiens
gtttgggccagtcac

SEQ ID NO: 55369 - DNA, 15 bp, Homo sapiens
tttgggccagtcact

SEQ ID NO: 55370 - DNA, 15 bp, Homo sapiens
ttgggccagtcactt

SEQ ID NO: 55371 - DNA, 15 bp, Homo sapiens
tgggccagtcacttc

SEQ ID NO: 55372 - DNA, 15 bp, Homo sapiens
gggccagtcacttcc

SEQ ID NO: 55373 - DNA, 15 bp, Homo sapiens
ggccagtcacttccc

SEQ ID NO: 55374 - DNA, 15 bp, Homo sapiens
gccagtcacttccct

SEQ ID NO: 55375 - DNA, 15 bp, Homo sapiens
ccagtcacttccctc

SEQ ID NO: 55376 - DNA, 15 bp, Homo sapiens
cagtcacttccctct

SEQ ID NO: 55377 - DNA, 15 bp, Homo sapiens
agtcacttccctctg

SEQ ID NO: 55378 - DNA, 15 bp, Homo sapiens
gtcacttccctctgg

SEQ ID NO: 55379 - DNA, 15 bp, Homo sapiens
tcacttccctctggc

SEQ ID NO: 55380 - DNA, 15 bp, Homo sapiens
cacttccctctggcg

SEQ ID NO: 55381 - DNA, 15 bp, Homo sapiens
acttccctctggcgt

SEQ ID NO: 55382 - DNA, 15 bp, Homo sapiens
cttccctctggcgtt

SEQ ID NO: 55383 - DNA, 15 bp, Homo sapiens
ttccctctggcgttg

SEQ ID NO: 55384 - DNA, 15 bp, Homo sapiens
tccctctggcgttga

SEQ ID NO: 55385 - DNA, 15 bp, Homo sapiens
ccctctggcgttgag

SEQ ID NO: 55386 - DNA, 15 bp, Homo sapiens
cctctggcgttgagg

SEQ ID NO: 55387 - DNA, 15 bp, Homo sapiens
ctctggcgttgaggt

SEQ ID NO: 55388 - DNA, 15 bp, Homo sapiens
tctggcgttgaggtg

SEQ ID NO: 55389 - DNA, 15 bp, Homo sapiens
ctggcgttgaggtgc

SEQ ID NO: 55390 - DNA, 15 bp, Homo sapiens
tggcgttgaggtgct

SEQ ID NO: 55391 - DNA, 15 bp, Homo sapiens
ggcgttgaggtgctc

SEQ ID NO: 55392 - DNA, 15 bp, Homo sapiens
gcgttgaggtgctca

SEQ ID NO: 55393 - DNA, 15 bp, Homo sapiens
cgttgaggtgctcat

SEQ ID NO: 55394 - DNA, 15 bp, Homo sapiens
gttgaggtgctcatg

SEQ ID NO: 55395 - DNA, 15 bp, Homo sapiens
ttgaggtgctcatgt

SEQ ID NO: 55396 - DNA, 15 bp, Homo sapiens
tgaggtgctcatgta

SEQ ID NO: 55397 - DNA, 15 bp, Homo sapiens
gaggtgctcatgtac

SEQ ID NO: 55398 - DNA, 15 bp, Homo sapiens
aggtgctcatgtacc

SEQ ID NO: 55399 - DNA, 15 bp, Homo sapiens
ggtgctcatgtaccc

SEQ ID NO: 55400 - DNA, 15 bp, Homo sapiens
gtgctcatgtaccct

SEQ ID NO: 55401 - DNA, 15 bp, Homo sapiens
tgctcatgtaccctg

SEQ ID NO: 55402 - DNA, 15 bp, Homo sapiens
gctcatgtaccctgt

SEQ ID NO: 55403 - DNA, 15 bp, Homo sapiens
ctcatgtaccctgtg

SEQ ID NO: 55404 - DNA, 15 bp, Homo sapiens
tcatgtaccctgtgc

SEQ ID NO: 55405 - DNA, 15 bp, Homo sapiens
catgtaccctgtgcc

SEQ ID NO: 55406 - DNA, 15 bp, Homo sapiens
atgtaccctgtgccc

SEQ ID NO: 55407 - DNA, 15 bp, Homo sapiens
tgtaccctgtgccct

SEQ ID NO: 55408 - DNA, 15 bp, Homo sapiens
gtaccctgtgccctt

SEQ ID NO: 55409 - DNA, 15 bp, Homo sapiens
taccctgtgcccttc

SEQ ID NO: 55410 - DNA, 15 bp, Homo sapiens
accctgtgcccttcc

SEQ ID NO: 55411 - DNA, 15 bp, Homo sapiens
ccctgtgcccttccg

SEQ ID NO: 55412 - DNA, 15 bp, Homo sapiens
cctgtgcccttccgg

SEQ ID NO: 55413 - DNA, 15 bp, Homo sapiens
ctgtgcccttccgga

SEQ ID NO: 55414 - DNA, 15 bp, Homo sapiens
tgtgcccttccggag

SEQ ID NO: 55415 - DNA, 15 bp, Homo sapiens
gtgcccttccggaga

SEQ ID NO: 55416 - DNA, 15 bp, Homo sapiens
tgcccttccggagag

SEQ ID NO: 55417 - DNA, 15 bp, Homo sapiens
gcccttccggagaga

SEQ ID NO: 55418 - DNA, 15 bp, Homo sapiens
cccttccggagagat

SEQ ID NO: 55419 - DNA, 15 bp, Homo sapiens
ccttccggagagatt

SEQ ID NO: 55420 - DNA, 15 bp, Homo sapiens
cttccggagagattc

SEQ ID NO: 55421 - DNA, 15 bp, Homo sapiens
ttccggagagattcc

SEQ ID NO: 55422 - DNA, 15 bp, Homo sapiens
tccggagagattcca

SEQ ID NO: 55423 - DNA, 15 bp, Homo sapiens
ccggagagattccag

SEQ ID NO: 55424 - DNA, 15 bp, Homo sapiens
cggagagattccagc

SEQ ID NO: 55425 - DNA, 15 bp, Homo sapiens
ggagagattccagca

SEQ ID NO: 55426 - DNA, 15 bp, Homo sapiens
gagagattccagcat

SEQ ID NO: 55427 - DNA, 15 bp, Homo sapiens
agagattccagcatg

SEQ ID NO: 55428 - DNA, 15 bp, Homo sapiens
gagattccagcatgc

SEQ ID NO: 55429 - DNA, 15 bp, Homo sapiens
agattccagcatgct

SEQ ID NO: 55430 - DNA, 15 bp, Homo sapiens
gattccagcatgctg

SEQ ID NO: 55431 - DNA, 15 bp, Homo sapiens
attccagcatgctgt

SEQ ID NO: 55432 - DNA, 15 bp, Homo sapiens
ttccagcatgctgtg

SEQ ID NO: 55433 - DNA, 15 bp, Homo sapiens
tccagcatgctgtgc

SEQ ID NO: 55434 - DNA, 15 bp, Homo sapiens
ccagcatgctgtgca

SEQ ID NO: 55435 - DNA, 15 bp, Homo sapiens
cagcatgctgtgcac

SEQ ID NO: 55436 - DNA, 15 bp, Homo sapiens
agcatgctgtgcaca

SEQ ID NO: 55437 - DNA, 15 bp, Homo sapiens
gcatgctgtgcacac

SEQ ID NO: 55438 - DNA, 15 bp, Homo sapiens
catgctgtgcacacc

SEQ ID NO: 55439 - DNA, 15 bp, Homo sapiens
atgctgtgcacacct

SEQ ID NO: 55440 - DNA, 15 bp, Homo sapiens
tgctgtgcacacctg

SEQ ID NO: 55441 - DNA, 15 bp, Homo sapiens
gctgtgcacacctgc

SEQ ID NO: 55442 - DNA, 15 bp, Homo sapiens
ctgtgcacacctgca

SEQ ID NO: 55443 - DNA, 15 bp, Homo sapiens
tgtgcacacctgcat

SEQ ID NO: 55444 - DNA, 15 bp, Homo sapiens
gtgcacacctgcatg

SEQ ID NO: 55445 - DNA, 15 bp, Homo sapiens
tgcacacctgcatgt

SEQ ID NO: 55446 - DNA, 15 bp, Homo sapiens
gcacacctgcatgtt

SEQ ID NO: 55447 - DNA, 15 bp, Homo sapiens
cacacctgcatgttg

SEQ ID NO: 55448 - DNA, 15 bp, Homo sapiens
acacctgcatgttga

SEQ ID NO: 55449 - DNA, 15 bp, Homo sapiens
cacctgcatgttgac

SEQ ID NO: 55450 - DNA, 15 bp, Homo sapiens
acctgcatgttgacc

SEQ ID NO: 55451 - DNA, 15 bp, Homo sapiens
cctgcatgttgaccc

SEQ ID NO: 55452 - DNA, 15 bp, Homo sapiens
ctgcatgttgaccct

SEQ ID NO: 55453 - DNA, 15 bp, Homo sapiens
tgcatgttgaccctt

SEQ ID NO: 55454 - DNA, 15 bp, Homo sapiens
gcatgttgacccttg

SEQ ID NO: 55455 - DNA, 15 bp, Homo sapiens
catgttgacccttgt

SEQ ID NO: 55456 - DNA, 15 bp, Homo sapiens
atgttgacccttgtc

SEQ ID NO: 55457 - DNA, 15 bp, Homo sapiens
tgttgacccttgtct

SEQ ID NO: 55458 - DNA, 15 bp, Homo sapiens
gttgacccttgtctt

SEQ ID NO: 55459 - DNA, 15 bp, Homo sapiens
ttgacccttgtcttg

SEQ ID NO: 55460 - DNA, 15 bp, Homo sapiens
tgacccttgtcttgc

SEQ ID NO: 55461 - DNA, 15 bp, Homo sapiens
gacccttgtcttgcc

SEQ ID NO: 55462 - DNA, 15 bp, Homo sapiens
acccttgtcttgcct

SEQ ID NO: 55463 - DNA, 15 bp, Homo sapiens
cccttgtcttgcctt

SEQ ID NO: 55464 - DNA, 15 bp, Homo sapiens
ccttgtcttgccttc

SEQ ID NO: 55465 - DNA, 15 bp, Homo sapiens
cttgtcttgccttct

SEQ ID NO: 55466 - DNA, 15 bp, Homo sapiens
ttgtcttgccttctt

SEQ ID NO: 55467 - DNA, 15 bp, Homo sapiens
tgtcttgccttcttc

SEQ ID NO: 55468 - DNA, 15 bp, Homo sapiens
gtcttgccttcttcc

SEQ ID NO: 55469 - DNA, 15 bp, Homo sapiens
tcttgccttcttcct

SEQ ID NO: 55470 - DNA, 15 bp, Homo sapiens
cttgccttcttcctg

SEQ ID NO: 55471 - DNA, 15 bp, Homo sapiens
ttgccttcttcctgc

SEQ ID NO: 55472 - DNA, 15 bp, Homo sapiens
tgccttcttcctgct

SEQ ID NO: 55473 - DNA, 15 bp, Homo sapiens
gccttcttcctgctt

SEQ ID NO: 55474 - DNA, 15 bp, Homo sapiens
ccttcttcctgcttg

SEQ ID NO: 55475 - DNA, 15 bp, Homo sapiens
cttcttcctgcttgt

SEQ ID NO: 55476 - DNA, 15 bp, Homo sapiens
ttcttcctgcttgtc

SEQ ID NO: 55477 - DNA, 15 bp, Homo sapiens
tcttcctgcttgtca

SEQ ID NO: 55478 - DNA, 15 bp, Homo sapiens
cttcctgcttgtcag

SEQ ID NO: 55479 - DNA, 15 bp, Homo sapiens
ttcctgcttgtcaga

SEQ ID NO: 55480 - DNA, 15 bp, Homo sapiens
tcctgcttgtcagat

SEQ ID NO: 55481 - DNA, 15 bp, Homo sapiens
cctgcttgtcagatc

SEQ ID NO: 55482 - DNA, 15 bp, Homo sapiens
ctgcttgtcagatcc

SEQ ID NO: 55483 - DNA, 15 bp, Homo sapiens
tgcttgtcagatcct

SEQ ID NO: 55484 - DNA, 15 bp, Homo sapiens
gcttgtcagatcctt

SEQ ID NO: 55485 - DNA, 15 bp, Homo sapiens
cttgtcagatccttc

SEQ ID NO: 55486 - DNA, 15 bp, Homo sapiens
ttgtcagatccttcc

SEQ ID NO: 55487 - DNA, 15 bp, Homo sapiens
tgtcagatccttcca

SEQ ID NO: 55488 - DNA, 15 bp, Homo sapiens
gtcagatccttccat

SEQ ID NO: 55489 - DNA, 15 bp, Homo sapiens
tcagatccttccata

SEQ ID NO: 55490 - DNA, 15 bp, Homo sapiens
cagatccttccatat

SEQ ID NO: 55491 - DNA, 15 bp, Homo sapiens
agatccttccatatc

SEQ ID NO: 55492 - DNA, 15 bp, Homo sapiens
gatccttccatatcc

SEQ ID NO: 55493 - DNA, 15 bp, Homo sapiens
atccttccatatccg

SEQ ID NO: 55494 - DNA, 15 bp, Homo sapiens
tccttccatatccgg

SEQ ID NO: 55495 - DNA, 15 bp, Homo sapiens
ccttccatatccgga

SEQ ID NO: 55496 - DNA, 15 bp, Homo sapiens
cttccatatccggac

SEQ ID NO: 55497 - DNA, 15 bp, Homo sapiens
ttccatatccggaca

SEQ ID NO: 55498 - DNA, 15 bp, Homo sapiens
tccatatccggacat

SEQ ID NO: 55499 - DNA, 15 bp, Homo sapiens
ccatatccggacatg

SEQ ID NO: 55500 - DNA, 15 bp, Homo sapiens
catatccggacatgc

SEQ ID NO: 55501 - DNA, 15 bp, Homo sapiens
atatccggacatgcg

SEQ ID NO: 55502 - DNA, 15 bp, Homo sapiens
tatccggacatgcgt

SEQ ID NO: 55503 - DNA, 15 bp, Homo sapiens
atccggacatgcgta

SEQ ID NO: 55504 - DNA, 15 bp, Homo sapiens
tccggacatgcgtag

SEQ ID NO: 55505 - DNA, 15 bp, Homo sapiens
ccggacatgcgtagt

SEQ ID NO: 55506 - DNA, 15 bp, Homo sapiens
cggacatgcgtagtg

SEQ ID NO: 55507 - DNA, 15 bp, Homo sapiens
ggacatgcgtagtgc

SEQ ID NO: 55508 - DNA, 15 bp, Homo sapiens
gacatgcgtagtgcc

SEQ ID NO: 55509 - DNA, 15 bp, Homo sapiens
acatgcgtagtgcct

SEQ ID NO: 55510 - DNA, 15 bp, Homo sapiens
catgcgtagtgcctc

SEQ ID NO: 55511 - DNA, 15 bp, Homo sapiens
atgcgtagtgcctca

SEQ ID NO: 55512 - DNA, 15 bp, Homo sapiens
tgcgtagtgcctcat

SEQ ID NO: 55513 - DNA, 15 bp, Homo sapiens
gcgtagtgcctcatc

SEQ ID NO: 55514 - DNA, 15 bp, Homo sapiens
cgtagtgcctcatcc

SEQ ID NO: 55515 - DNA, 15 bp, Homo sapiens
gtagtgcctcatcct

SEQ ID NO: 55516 - DNA, 15 bp, Homo sapiens
tagtgcctcatcctt

SEQ ID NO: 55517 - DNA, 15 bp, Homo sapiens
agtgcctcatccttg

SEQ ID NO: 55518 - DNA, 15 bp, Homo sapiens
gtgcctcatccttgc

SEQ ID NO: 55519 - DNA, 15 bp, Homo sapiens
tgcctcatccttgca

SEQ ID NO: 55520 - DNA, 15 bp, Homo sapiens
gcctcatccttgcag

SEQ ID NO: 55521 - DNA, 15 bp, Homo sapiens
cctcatccttgcagc

SEQ ID NO: 55522 - DNA, 15 bp, Homo sapiens
ctcatccttgcagcc

SEQ ID NO: 55523 - DNA, 15 bp, Homo sapiens
tcatccttgcagcca

SEQ ID NO: 55524 - DNA, 15 bp, Homo sapiens
catccttgcagccag

SEQ ID NO: 55525 - DNA, 15 bp, Homo sapiens
atccttgcagccagc

SEQ ID NO: 55526 - DNA, 15 bp, Homo sapiens
tccttgcagccagcg

SEQ ID NO: 55527 - DNA, 15 bp, Homo sapiens
ccttgcagccagcgg

SEQ ID NO: 55528 - DNA, 15 bp, Homo sapiens
cttgcagccagcggc

SEQ ID NO: 55529 - DNA, 15 bp, Homo sapiens
ttgcagccagcggcc

SEQ ID NO: 55530 - DNA, 15 bp, Homo sapiens
tgcagccagcggcct

SEQ ID NO: 55531 - DNA, 15 bp, Homo sapiens
gcagccagcggcctt

SEQ ID NO: 55532 - DNA, 15 bp, Homo sapiens
cagccagcggccttc

SEQ ID NO: 55533 - DNA, 15 bp, Homo sapiens
agccagcggccttca

SEQ ID NO: 55534 - DNA, 15 bp, Homo sapiens
gccagcggccttcat

SEQ ID NO: 55535 - DNA, 15 bp, Homo sapiens
ccagcggccttcatg

SEQ ID NO: 55536 - DNA, 15 bp, Homo sapiens
cagcggccttcatgc

SEQ ID NO: 55537 - DNA, 15 bp, Homo sapiens
agcggccttcatgct

SEQ ID NO: 55538 - DNA, 15 bp, Homo sapiens
gcggccttcatgctc

SEQ ID NO: 55539 - DNA, 15 bp, Homo sapiens
cggccttcatgctcc

SEQ ID NO: 55540 - DNA, 15 bp, Homo sapiens
ggccttcatgctcca

SEQ ID NO: 55541 - DNA, 15 bp, Homo sapiens
gccttcatgctccac

SEQ ID NO: 55542 - DNA, 15 bp, Homo sapiens
ccttcatgctccact

SEQ ID NO: 55543 - DNA, 15 bp, Homo sapiens
cttcatgctccactg

SEQ ID NO: 55544 - DNA, 15 bp, Homo sapiens
ttcatgctccactgt

SEQ ID NO: 55545 - DNA, 15 bp, Homo sapiens
tcatgctccactgta

SEQ ID NO: 55546 - DNA, 15 bp, Homo sapiens
catgctccactgtaa

SEQ ID NO: 55547 - DNA, 15 bp, Homo sapiens
atgctccactgtaat

SEQ ID NO: 55548 - DNA, 15 bp, Homo sapiens
tgctccactgtaatt

SEQ ID NO: 55549 - DNA, 15 bp, Homo sapiens
gctccactgtaattc

SEQ ID NO: 55550 - DNA, 15 bp, Homo sapiens
ctccactgtaattcg

SEQ ID NO: 55551 - DNA, 15 bp, Homo sapiens
tccactgtaattcgt

SEQ ID NO: 55552 - DNA, 15 bp, Homo sapiens
ccactgtaattcgtg

SEQ ID NO: 55553 - DNA, 15 bp, Homo sapiens
cactgtaattcgtgg

SEQ ID NO: 55554 - DNA, 15 bp, Homo sapiens
actgtaattcgtggg

SEQ ID NO: 55555 - DNA, 15 bp, Homo sapiens
ctgtaattcgtgggt

SEQ ID NO: 55556 - DNA, 15 bp, Homo sapiens
tgtaattcgtgggtt

SEQ ID NO: 55557 - DNA, 15 bp, Homo sapiens
gtaattcgtgggtta

SEQ ID NO: 55558 - DNA, 15 bp, Homo sapiens
taattcgtgggttag

SEQ ID NO: 55559 - DNA, 15 bp, Homo sapiens
aattcgtgggttagt

SEQ ID NO: 55560 - DNA, 15 bp, Homo sapiens
attcgtgggttagtg

SEQ ID NO: 55561 - DNA, 15 bp, Homo sapiens
ttcgtgggttagtgg

SEQ ID NO: 55562 - DNA, 15 bp, Homo sapiens
tcgtgggttagtggg

SEQ ID NO: 55563 - DNA, 15 bp, Homo sapiens
cgtgggttagtgggt

SEQ ID NO: 55564 - DNA, 15 bp, Homo sapiens
gtgggttagtgggta

SEQ ID NO: 55565 - DNA, 15 bp, Homo sapiens
tgggttagtgggtat

SEQ ID NO: 55566 - DNA, 15 bp, Homo sapiens
gggttagtgggtata

SEQ ID NO: 55567 - DNA, 15 bp, Homo sapiens
ggttagtgggtatat

SEQ ID NO: 55568 - DNA, 15 bp, Homo sapiens
gttagtgggtatatg

SEQ ID NO: 55569 - DNA, 15 bp, Homo sapiens
ttagtgggtatatgc

SEQ ID NO: 55570 - DNA, 15 bp, Homo sapiens
tagtgggtatatgca

SEQ ID NO: 55571 - DNA, 15 bp, Homo sapiens
agtgggtatatgcac

SEQ ID NO: 55572 - DNA, 15 bp, Homo sapiens
gtgggtatatgcact

SEQ ID NO: 55573 - DNA, 15 bp, Homo sapiens
tgggtatatgcactt

SEQ ID NO: 55574 - DNA, 15 bp, Homo sapiens
gggtatatgcacttg

SEQ ID NO: 55575 - DNA, 15 bp, Homo sapiens
ggtatatgcacttgt

SEQ ID NO: 55576 - DNA, 15 bp, Homo sapiens
gtatatgcacttgtt

SEQ ID NO: 55577 - DNA, 15 bp, Homo sapiens
tatatgcacttgttg

SEQ ID NO: 55578 - DNA, 15 bp, Homo sapiens
atatgcacttgttgt

SEQ ID NO: 55579 - DNA, 15 bp, Homo sapiens
tatgcacttgttgtt

SEQ ID NO: 55580 - DNA, 15 bp, Homo sapiens
atgcacttgttgttt

SEQ ID NO: 55581 - DNA, 15 bp, Homo sapiens
tgcacttgttgtttt

SEQ ID NO: 55582 - DNA, 15 bp, Homo sapiens
gcacttgttgttttt

SEQ ID NO: 55583 - DNA, 15 bp, Homo sapiens
cacttgttgtttttg

SEQ ID NO: 55584 - DNA, 15 bp, Homo sapiens
acttgttgtttttga

SEQ ID NO: 55585 - DNA, 15 bp, Homo sapiens
cttgttgtttttgat

SEQ ID NO: 55586 - DNA, 15 bp, Homo sapiens
ttgttgtttttgatg

SEQ ID NO: 55587 - DNA, 15 bp, Homo sapiens
tgttgtttttgatgc

SEQ ID NO: 55588 - DNA, 15 bp, Homo sapiens
gttgtttttgatgct

SEQ ID NO: 55589 - DNA, 15 bp, Homo sapiens
ttgtttttgatgcta

SEQ ID NO: 55590 - DNA, 15 bp, Homo sapiens
tgtttttgatgctac

SEQ ID NO: 55591 - DNA, 15 bp, Homo sapiens
gtttttgatgctacc

SEQ ID NO: 55592 - DNA, 15 bp, Homo sapiens
tttttgatgctacca

SEQ ID NO: 55593 - DNA, 15 bp, Homo sapiens
ttttgatgctaccac

SEQ ID NO: 55594 - DNA, 15 bp, Homo sapiens
tttgatgctaccaca

SEQ ID NO: 55595 - DNA, 15 bp, Homo sapiens
ttgatgctaccacat

SEQ ID NO: 55596 - DNA, 15 bp, Homo sapiens
tgatgctaccacatg

SEQ ID NO: 55597 - DNA, 15 bp, Homo sapiens
gatgctaccacatgg

SEQ ID NO: 55598 - DNA, 15 bp, Homo sapiens
atgctaccacatggg

SEQ ID NO: 55599 - DNA, 15 bp, Homo sapiens
tgctaccacatgggg

SEQ ID NO: 55600 - DNA, 15 bp, Homo sapiens
gctaccacatgggga

SEQ ID NO: 55601 - DNA, 15 bp, Homo sapiens
ctaccacatggggat

SEQ ID NO: 55602 - DNA, 15 bp, Homo sapiens
taccacatggggata

SEQ ID NO: 55603 - DNA, 15 bp, Homo sapiens
accacatggggatat

SEQ ID NO: 55604 - DNA, 15 bp, Homo sapiens
ccacatggggatatt

SEQ ID NO: 55605 - DNA, 15 bp, Homo sapiens
cacatggggatattt

SEQ ID NO: 55606 - DNA, 15 bp, Homo sapiens
acatggggatatttg

SEQ ID NO: 55607 - DNA, 15 bp, Homo sapiens
catggggatatttgc

SEQ ID NO: 55608 - DNA, 15 bp, Homo sapiens
atggggatatttgcc

SEQ ID NO: 55609 - DNA, 15 bp, Homo sapiens
tggggatatttgcct

SEQ ID NO: 55610 - DNA, 15 bp, Homo sapiens
ggggatatttgcctc

SEQ ID NO: 55611 - DNA, 15 bp, Homo sapiens
gggatatttgcctcg

SEQ ID NO: 55612 - DNA, 15 bp, Homo sapiens
ggatatttgcctcgt

SEQ ID NO: 55613 - DNA, 15 bp, Homo sapiens
gatatttgcctcgtc

SEQ ID NO: 55614 - DNA, 15 bp, Homo sapiens
atatttgcctcgtct

SEQ ID NO: 55615 - DNA, 15 bp, Homo sapiens
tatttgcctcgtctg

SEQ ID NO: 55616 - DNA, 15 bp, Homo sapiens
atttgcctcgtctga

SEQ ID NO: 55617 - DNA, 15 bp, Homo sapiens
tttgcctcgtctgaa

SEQ ID NO: 55618 - DNA, 15 bp, Homo sapiens
ttgcctcgtctgaac

SEQ ID NO: 55619 - DNA, 15 bp, Homo sapiens
tgcctcgtctgaact

SEQ ID NO: 55620 - DNA, 15 bp, Homo sapiens
gcctcgtctgaactc

SEQ ID NO: 55621 - DNA, 15 bp, Homo sapiens
cctcgtctgaactct

SEQ ID NO: 55622 - DNA, 15 bp, Homo sapiens
ctcgtctgaactctg

SEQ ID NO: 55623 - DNA, 15 bp, Homo sapiens
tcgtctgaactctgt

SEQ ID NO: 55624 - DNA, 15 bp, Homo sapiens
cgtctgaactctgtg

SEQ ID NO: 55625 - DNA, 15 bp, Homo sapiens
gtctgaactctgtgt

SEQ ID NO: 55626 - DNA, 15 bp, Homo sapiens
tctgaactctgtgta

SEQ ID NO: 55627 - DNA, 15 bp, Homo sapiens
ctgaactctgtgtat

SEQ ID NO: 55628 - DNA, 15 bp, Homo sapiens
tgaactctgtgtatt

SEQ ID NO: 55629 - DNA, 15 bp, Homo sapiens
gaactctgtgtattc

SEQ ID NO: 55630 - DNA, 15 bp, Homo sapiens
aactctgtgtattct

SEQ ID NO: 55631 - DNA, 15 bp, Homo sapiens
actctgtgtattctc

SEQ ID NO: 55632 - DNA, 15 bp, Homo sapiens
ctctgtgtattctct

SEQ ID NO: 55633 - DNA, 15 bp, Homo sapiens
tctgtgtattctctg

SEQ ID NO: 55634 - DNA, 15 bp, Homo sapiens
ctgtgtattctctgc

SEQ ID NO: 55635 - DNA, 15 bp, Homo sapiens
tgtgtattctctgct

SEQ ID NO: 55636 - DNA, 15 bp, Homo sapiens
gtgtattctctgctg

SEQ ID NO: 55637 - DNA, 15 bp, Homo sapiens
tgtattctctgctgc

SEQ ID NO: 55638 - DNA, 15 bp, Homo sapiens
gtattctctgctgca

SEQ ID NO: 55639 - DNA, 15 bp, Homo sapiens
tattctctgctgcac

SEQ ID NO: 55640 - DNA, 15 bp, Homo sapiens
attctctgctgcacc

SEQ ID NO: 55641 - DNA, 15 bp, Homo sapiens
ttctctgctgcacct

SEQ ID NO: 55642 - DNA, 15 bp, Homo sapiens
tctctgctgcacctt

SEQ ID NO: 55643 - DNA, 15 bp, Homo sapiens
ctctgctgcaccttg

SEQ ID NO: 55644 - DNA, 15 bp, Homo sapiens
tctgctgcaccttgt

SEQ ID NO: 55645 - DNA, 15 bp, Homo sapiens
ctgctgcaccttgtt

SEQ ID NO: 55646 - DNA, 15 bp, Homo sapiens
tgctgcaccttgttg

SEQ ID NO: 55647 - DNA, 15 bp, Homo sapiens
gctgcaccttgttgc

SEQ ID NO: 55648 - DNA, 15 bp, Homo sapiens
ctgcaccttgttgct

SEQ ID NO: 55649 - DNA, 15 bp, Homo sapiens
tgcaccttgttgctt

SEQ ID NO: 55650 - DNA, 15 bp, Homo sapiens
gcaccttgttgcttc

SEQ ID NO: 55651 - DNA, 15 bp, Homo sapiens
caccttgttgcttct

SEQ ID NO: 55652 - DNA, 15 bp, Homo sapiens
accttgttgcttctt

SEQ ID NO: 55653 - DNA, 15 bp, Homo sapiens
ccttgttgcttcttt

SEQ ID NO: 55654 - DNA, 15 bp, Homo sapiens
cttgttgcttctttg

SEQ ID NO: 55655 - DNA, 15 bp, Homo sapiens
ttgttgcttctttgc

SEQ ID NO: 55656 - DNA, 15 bp, Homo sapiens
tgttgcttctttgca

SEQ ID NO: 55657 - DNA, 15 bp, Homo sapiens
gttgcttctttgcaa

SEQ ID NO: 55658 - DNA, 15 bp, Homo sapiens
ttgcttctttgcaat

SEQ ID NO: 55659 - DNA, 15 bp, Homo sapiens
tgcttctttgcaata

SEQ ID NO: 55660 - DNA, 15 bp, Homo sapiens
gcttctttgcaataa

SEQ ID NO: 55661 - DNA, 15 bp, Homo sapiens
cttctttgcaataaa

SEQ ID NO: 55662 - DNA, 15 bp, Homo sapiens
ttctttgcaataaac

SEQ ID NO: 55663 - DNA, 15 bp, Homo sapiens
tctttgcaataaact

SEQ ID NO: 55664 - DNA, 15 bp, Homo sapiens
ctttgcaataaactt

SEQ ID NO: 55665 - DNA, 15 bp, Homo sapiens
tttgcaataaacttc

SEQ ID NO: 55666 - DNA, 15 bp, Homo sapiens
ttgcaataaacttcc

SEQ ID NO: 55667 - DNA, 15 bp, Homo sapiens
tgcaataaacttcct

SEQ ID NO: 55668 - DNA, 15 bp, Homo sapiens
gcaataaacttcctg

SEQ ID NO: 55669 - DNA, 15 bp, Homo sapiens
caataaacttcctga

SEQ ID NO: 55670 - DNA, 15 bp, Homo sapiens
aataaacttcctgaa

SEQ ID NO: 55671 - DNA, 15 bp, Homo sapiens
ataaacttcctgaac

SEQ ID NO: 55672 - DNA, 15 bp, Homo sapiens
taaacttcctgaact

SEQ ID NO: 55673 - DNA, 15 bp, Homo sapiens
aaacttcctgaactc

SEQ ID NO: 55674 - DNA, 15 bp, Homo sapiens
aacttcctgaactca

SEQ ID NO: 55675 - DNA, 15 bp, Homo sapiens
acttcctgaactcaa

SEQ ID NO: 55676 - DNA, 15 bp, Homo sapiens
cttcctgaactcaaa

SEQ ID NO: 55677 - DNA, 15 bp, Homo sapiens
ttcctgaactcaaag

SEQ ID NO: 55678 - DNA, 15 bp, Homo sapiens
tcctgaactcaaagc

SEQ ID NO: 55679 - DNA, 15 bp, Homo sapiens
cctgaactcaaagct

SEQ ID NO: 55680 - DNA, 15 bp, Homo sapiens
ctgaactcaaagcta

SEQ ID NO: 55681 - DNA, 15 bp, Homo sapiens
tgaactcaaagctaa

SEQ ID NO: 55682 - DNA, 15 bp, Homo sapiens
gaactcaaagctaat

SEQ ID NO: 55683 - DNA, 15 bp, Homo sapiens
aactcaaagctaata

SEQ ID NO: 55684 - DNA, 15 bp, Homo sapiens
actcaaagctaatac

SEQ ID NO: 55685 - DNA, 15 bp, Homo sapiens
ctcaaagctaatact

SEQ ID NO: 55686 - DNA, 15 bp, Homo sapiens
tcaaagctaatactg

SEQ ID NO: 55687 - DNA, 15 bp, Homo sapiens
caaagctaatactgg

SEQ ID NO: 55688 - DNA, 15 bp, Homo sapiens
aaagctaatactggg

SEQ ID NO: 55689 - DNA, 15 bp, Homo sapiens
aagctaatactgggg

SEQ ID NO: 55690 - DNA, 15 bp, Homo sapiens
agctaatactggggg

SEQ ID NO: 55691 - DNA, 15 bp, Homo sapiens
gctaatactgggggg

SEQ ID NO: 55692 - DNA, 15 bp, Homo sapiens
ctaatactgggggga

SEQ ID NO: 55693 - DNA, 15 bp, Homo sapiens
taatactggggggaa

SEQ ID NO: 55694 - DNA, 15 bp, Homo sapiens
aatactggggggaat

SEQ ID NO: 55695 - DNA, 15 bp, Homo sapiens
atactggggggaatc

SEQ ID NO: 55696 - DNA, 15 bp, Homo sapiens
tactggggggaatcc

SEQ ID NO: 55697 - DNA, 15 bp, Homo sapiens
actggggggaatccc

SEQ ID NO: 55698 - DNA, 15 bp, Homo sapiens
ctggggggaatccca

SEQ ID NO: 55699 - DNA, 15 bp, Homo sapiens
tggggggaatcccag

SEQ ID NO: 55700 - DNA, 15 bp, Homo sapiens
ggggggaatcccaga

SEQ ID NO: 55701 - DNA, 15 bp, Homo sapiens
gggggaatcccagaa

SEQ ID NO: 55702 - DNA, 15 bp, Homo sapiens
ggggaatcccagaag

SEQ ID NO: 55703 - DNA, 15 bp, Homo sapiens
gggaatcccagaagc

SEQ ID NO: 55704 - DNA, 15 bp, Homo sapiens
ggaatcccagaagct

SEQ ID NO: 55705 - DNA, 15 bp, Homo sapiens
gaatcccagaagctg

SEQ ID NO: 55706 - DNA, 15 bp, Homo sapiens
aatcccagaagctgc

SEQ ID NO: 55707 - DNA, 15 bp, Homo sapiens
atcccagaagctgct

SEQ ID NO: 55708 - DNA, 15 bp, Homo sapiens
tcccagaagctgctg

SEQ ID NO: 55709 - DNA, 15 bp, Homo sapiens
cccagaagctgctga

SEQ ID NO: 55710 - DNA, 15 bp, Homo sapiens
ccagaagctgctgag

SEQ ID NO: 55711 - DNA, 15 bp, Homo sapiens
cagaagctgctgagg

SEQ ID NO: 55712 - DNA, 15 bp, Homo sapiens
agaagctgctgaggg

SEQ ID NO: 55713 - DNA, 15 bp, Homo sapiens
gaagctgctgagggc

SEQ ID NO: 55714 - DNA, 15 bp, Homo sapiens
aagctgctgagggca

SEQ ID NO: 55715 - DNA, 15 bp, Homo sapiens
agctgctgagggcag

SEQ ID NO: 55716 - DNA, 15 bp, Homo sapiens
gctgctgagggcagg

SEQ ID NO: 55717 - DNA, 15 bp, Homo sapiens
ctgctgagggcaggg

SEQ ID NO: 55718 - DNA, 15 bp, Homo sapiens
tgctgagggcagggc

SEQ ID NO: 55719 - DNA, 15 bp, Homo sapiens
gctgagggcagggcc

SEQ ID NO: 55720 - DNA, 15 bp, Homo sapiens
ctgagggcagggcca

SEQ ID NO: 55721 - DNA, 15 bp, Homo sapiens
tgagggcagggccat

SEQ ID NO: 55722 - DNA, 15 bp, Homo sapiens
gagggcagggccatg

SEQ ID NO: 55723 - DNA, 15 bp, Homo sapiens
agggcagggccatgc

SEQ ID NO: 55724 - DNA, 15 bp, Homo sapiens
gggcagggccatgct

SEQ ID NO: 55725 - DNA, 15 bp, Homo sapiens
ggcagggccatgctg

SEQ ID NO: 55726 - DNA, 15 bp, Homo sapiens
gcagggccatgctgc

SEQ ID NO: 55727 - DNA, 15 bp, Homo sapiens
cagggccatgctgct

SEQ ID NO: 55728 - DNA, 15 bp, Homo sapiens
agggccatgctgctc

SEQ ID NO: 55729 - DNA, 15 bp, Homo sapiens
gggccatgctgctca

SEQ ID NO: 55730 - DNA, 15 bp, Homo sapiens
ggccatgctgctcag

SEQ ID NO: 55731 - DNA, 15 bp, Homo sapiens
gccatgctgctcagt

SEQ ID NO: 55732 - DNA, 15 bp, Homo sapiens
ccatgctgctcagtg

SEQ ID NO: 55733 - DNA, 15 bp, Homo sapiens
catgctgctcagtgt

SEQ ID NO: 55734 - DNA, 15 bp, Homo sapiens
atgctgctcagtgtt

SEQ ID NO: 55735 - DNA, 15 bp, Homo sapiens
tgctgctcagtgttc

SEQ ID NO: 55736 - DNA, 15 bp, Homo sapiens
gctgctcagtgttcc

SEQ ID NO: 55737 - DNA, 15 bp, Homo sapiens
ctgctcagtgttcca

SEQ ID NO: 55738 - DNA, 15 bp, Homo sapiens
tgctcagtgttccac

SEQ ID NO: 55739 - DNA, 15 bp, Homo sapiens
gctcagtgttccacc

SEQ ID NO: 55740 - DNA, 15 bp, Homo sapiens
ctcagtgttccaccc

SEQ ID NO: 55741 - DNA, 15 bp, Homo sapiens
tcagtgttccaccct

SEQ ID NO: 55742 - DNA, 15 bp, Homo sapiens
cagtgttccacccta

SEQ ID NO: 55743 - DNA, 15 bp, Homo sapiens
agtgttccaccctag

SEQ ID NO: 55744 - DNA, 15 bp, Homo sapiens
gtgttccaccctagc

SEQ ID NO: 55745 - DNA, 15 bp, Homo sapiens
tgttccaccctagct

SEQ ID NO: 55746 - DNA, 15 bp, Homo sapiens
gttccaccctagctc

SEQ ID NO: 55747 - DNA, 15 bp, Homo sapiens
ttccaccctagctcc

SEQ ID NO: 55748 - DNA, 15 bp, Homo sapiens
tccaccctagctcct

SEQ ID NO: 55749 - DNA, 15 bp, Homo sapiens
ccaccctagctcctg

SEQ ID NO: 55750 - DNA, 15 bp, Homo sapiens
caccctagctcctga

SEQ ID NO: 55751 - DNA, 15 bp, Homo sapiens
accctagctcctgac

SEQ ID NO: 55752 - DNA, 15 bp, Homo sapiens
ccctagctcctgaca

SEQ ID NO: 55753 - DNA, 15 bp, Homo sapiens
cctagctcctgacag

SEQ ID NO: 55754 - DNA, 15 bp, Homo sapiens
ctagctcctgacagc

SEQ ID NO: 55755 - DNA, 15 bp, Homo sapiens
tagctcctgacagca

SEQ ID NO: 55756 - DNA, 15 bp, Homo sapiens
agctcctgacagcat

SEQ ID NO: 55757 - DNA, 15 bp, Homo sapiens
gctcctgacagcatt

SEQ ID NO: 55758 - DNA, 15 bp, Homo sapiens
ctcctgacagcattt

SEQ ID NO: 55759 - DNA, 15 bp, Homo sapiens
tcctgacagcatttc

SEQ ID NO: 55760 - DNA, 15 bp, Homo sapiens
cctgacagcatttcc

SEQ ID NO: 55761 - DNA, 15 bp, Homo sapiens
ctgacagcatttccc

SEQ ID NO: 55762 - DNA, 15 bp, Homo sapiens
tgacagcatttccct

SEQ ID NO: 55763 - DNA, 15 bp, Homo sapiens
gacagcatttcccta

SEQ ID NO: 55764 - DNA, 15 bp, Homo sapiens
acagcatttccctag

SEQ ID NO: 55765 - DNA, 15 bp, Homo sapiens
cagcatttccctaga

SEQ ID NO: 55766 - DNA, 15 bp, Homo sapiens
agcatttccctagaa

SEQ ID NO: 55767 - DNA, 15 bp, Homo sapiens
gcatttccctagaaa

SEQ ID NO: 55768 - DNA, 15 bp, Homo sapiens
catttccctagaaaa

SEQ ID NO: 55769 - DNA, 15 bp, Homo sapiens
atttccctagaaaac

SEQ ID NO: 55770 - DNA, 15 bp, Homo sapiens
tttccctagaaaact

SEQ ID NO: 55771 - DNA, 15 bp, Homo sapiens
ttccctagaaaactg

SEQ ID NO: 55772 - DNA, 15 bp, Homo sapiens
tccctagaaaactgc

SEQ ID NO: 55773 - DNA, 15 bp, Homo sapiens
ccctagaaaactgct

SEQ ID NO: 55774 - DNA, 15 bp, Homo sapiens
cctagaaaactgctg

SEQ ID NO: 55775 - DNA, 15 bp, Homo sapiens
ctagaaaactgctgc

SEQ ID NO: 55776 - DNA, 15 bp, Homo sapiens
tagaaaactgctgct

SEQ ID NO: 55777 - DNA, 15 bp, Homo sapiens
agaaaactgctgctg

SEQ ID NO: 55778 - DNA, 15 bp, Homo sapiens
gaaaactgctgctgg

SEQ ID NO: 55779 - DNA, 15 bp, Homo sapiens
aaaactgctgctggg

SEQ ID NO: 55780 - DNA, 15 bp, Homo sapiens
aaactgctgctgggc

SEQ ID NO: 55781 - DNA, 15 bp, Homo sapiens
aactgctgctgggcc

SEQ ID NO: 55782 - DNA, 15 bp, Homo sapiens
actgctgctgggcct

SEQ ID NO: 55783 - DNA, 15 bp, Homo sapiens
ctgctgctgggcctc

SEQ ID NO: 55784 - DNA, 15 bp, Homo sapiens
tgctgctgggcctct

SEQ ID NO: 55785 - DNA, 15 bp, Homo sapiens
gctgctgggcctcta

SEQ ID NO: 55786 - DNA, 15 bp, Homo sapiens
ctgctgggcctctaa

SEQ ID NO: 55787 - DNA, 15 bp, Homo sapiens
tgctgggcctctaat

SEQ ID NO: 55788 - DNA, 15 bp, Homo sapiens
gctgggcctctaatg

SEQ ID NO: 55789 - DNA, 15 bp, Homo sapiens
ctgggcctctaatgg

SEQ ID NO: 55790 - DNA, 15 bp, Homo sapiens
tgggcctctaatgga

SEQ ID NO: 55791 - DNA, 15 bp, Homo sapiens
gggcctctaatggag

SEQ ID NO: 55792 - DNA, 15 bp, Homo sapiens
ggcctctaatggagc

SEQ ID NO: 55793 - DNA, 15 bp, Homo sapiens
gcctctaatggagca

SEQ ID NO: 55794 - DNA, 15 bp, Homo sapiens
cctctaatggagcaa

SEQ ID NO: 55795 - DNA, 15 bp, Homo sapiens
ctctaatggagcaaa

SEQ ID NO: 55796 - DNA, 15 bp, Homo sapiens
tctaatggagcaaat

SEQ ID NO: 55797 - DNA, 15 bp, Homo sapiens
ctaatggagcaaata

SEQ ID NO: 55798 - DNA, 15 bp, Homo sapiens
taatggagcaaataa

SEQ ID NO: 55799 - DNA, 15 bp, Homo sapiens
aatggagcaaataaa

SEQ ID NO: 55800 - DNA, 15 bp, Homo sapiens
atggagcaaataaat

SEQ ID NO: 55801 - DNA, 15 bp, Homo sapiens
tggagcaaataaatc

SEQ ID NO: 55802 - DNA, 15 bp, Homo sapiens
ggagcaaataaatct

SEQ ID NO: 55803 - DNA, 15 bp, Homo sapiens
gagcaaataaatctg

SEQ ID NO: 55804 - DNA, 15 bp, Homo sapiens
agcaaataaatctgt

SEQ ID NO: 55805 - DNA, 15 bp, Homo sapiens
gcaaataaatctgtg

SEQ ID NO: 55806 - DNA, 15 bp, Homo sapiens
caaataaatctgtgt

SEQ ID NO: 55807 - DNA, 15 bp, Homo sapiens
aaataaatctgtgta

SEQ ID NO: 55808 - DNA, 15 bp, Homo sapiens
aataaatctgtgtac

SEQ ID NO: 55809 - DNA, 15 bp, Homo sapiens
ataaatctgtgtaca

SEQ ID NO: 55810 - DNA, 15 bp, Homo sapiens
taaatctgtgtacaa

SEQ ID NO: 55811 - DNA, 15 bp, Homo sapiens
aaatctgtgtacaac

SEQ ID NO: 55812 - DNA, 15 bp, Homo sapiens
aatctgtgtacaact

SEQ ID NO: 55813 - DNA, 15 bp, Homo sapiens
atctgtgtacaacta

SEQ ID NO: 55814 - DNA, 15 bp, Homo sapiens
tctgtgtacaactag

SEQ ID NO: 55815 - DNA, 15 bp, Homo sapiens
ctgtgtacaactagg

SEQ ID NO: 55816 - DNA, 15 bp, Homo sapiens
tgtgtacaactaggc

SEQ ID NO: 55817 - DNA, 15 bp, Homo sapiens
gtgtacaactaggca

SEQ ID NO: 55818 - DNA, 15 bp, Homo sapiens
tgtacaactaggcag

SEQ ID NO: 55819 - DNA, 15 bp, Homo sapiens
gtacaactaggcagc

SEQ ID NO: 55820 - DNA, 15 bp, Homo sapiens
tacaactaggcagca

SEQ ID NO: 55821 - DNA, 15 bp, Homo sapiens
acaactaggcagcaa

SEQ ID NO: 55822 - DNA, 15 bp, Homo sapiens
caactaggcagcaat

SEQ ID NO: 55823 - DNA, 15 bp, Homo sapiens
aactaggcagcaata

SEQ ID NO: 55824 - DNA, 15 bp, Homo sapiens
actaggcagcaatag

SEQ ID NO: 55825 - DNA, 15 bp, Homo sapiens
ctaggcagcaatagt

SEQ ID NO: 55826 - DNA, 15 bp, Homo sapiens
taggcagcaatagtt

SEQ ID NO: 55827 - DNA, 15 bp, Homo sapiens
aggcagcaatagttt

SEQ ID NO: 55828 - DNA, 15 bp, Homo sapiens
ggcagcaatagtttg

SEQ ID NO: 55829 - DNA, 15 bp, Homo sapiens
gcagcaatagtttgt

SEQ ID NO: 55830 - DNA, 15 bp, Homo sapiens
cagcaatagtttgtc

SEQ ID NO: 55831 - DNA, 15 bp, Homo sapiens
agcaatagtttgtcc

SEQ ID NO: 55832 - DNA, 15 bp, Homo sapiens
gcaatagtttgtcca

SEQ ID NO: 55833 - DNA, 15 bp, Homo sapiens
caatagtttgtccaa

SEQ ID NO: 55834 - DNA, 15 bp, Homo sapiens
aatagtttgtccaaa

SEQ ID NO: 55835 - DNA, 15 bp, Homo sapiens
atagtttgtccaaaa

SEQ ID NO: 55836 - DNA, 15 bp, Homo sapiens
tagtttgtccaaaag

SEQ ID NO: 55837 - DNA, 15 bp, Homo sapiens
agtttgtccaaaagt

SEQ ID NO: 55838 - DNA, 15 bp, Homo sapiens
gtttgtccaaaagtc

SEQ ID NO: 55839 - DNA, 15 bp, Homo sapiens
tttgtccaaaagtcc

SEQ ID NO: 55840 - DNA, 15 bp, Homo sapiens
ttgtccaaaagtcct

SEQ ID NO: 55841 - DNA, 15 bp, Homo sapiens
tgtccaaaagtcctg

SEQ ID NO: 55842 - DNA, 15 bp, Homo sapiens
gtccaaaagtcctgg

SEQ ID NO: 55843 - DNA, 15 bp, Homo sapiens
tccaaaagtcctggt

SEQ ID NO: 55844 - DNA, 15 bp, Homo sapiens
ccaaaagtcctggtg

SEQ ID NO: 55845 - DNA, 15 bp, Homo sapiens
caaaagtcctggtgt

SEQ ID NO: 55846 - DNA, 15 bp, Homo sapiens
aaaagtcctggtgta

SEQ ID NO: 55847 - DNA, 15 bp, Homo sapiens
aaagtcctggtgtaa

SEQ ID NO: 55848 - DNA, 15 bp, Homo sapiens
aagtcctggtgtaat

SEQ ID NO: 55849 - DNA, 15 bp, Homo sapiens
agtcctggtgtaatc

SEQ ID NO: 55850 - DNA, 15 bp, Homo sapiens
gtcctggtgtaatct

SEQ ID NO: 55851 - DNA, 15 bp, Homo sapiens
tcctggtgtaatcta

SEQ ID NO: 55852 - DNA, 15 bp, Homo sapiens
cctggtgtaatctag

SEQ ID NO: 55853 - DNA, 15 bp, Homo sapiens
ctggtgtaatctagt

SEQ ID NO: 55854 - DNA, 15 bp, Homo sapiens
tggtgtaatctagtc

SEQ ID NO: 55855 - DNA, 15 bp, Homo sapiens
ggtgtaatctagtcc

SEQ ID NO: 55856 - DNA, 15 bp, Homo sapiens
gtgtaatctagtccc

SEQ ID NO: 55857 - DNA, 15 bp, Homo sapiens
tgtaatctagtccct

SEQ ID NO: 55858 - DNA, 15 bp, Homo sapiens
gtaatctagtccctc

SEQ ID NO: 55859 - DNA, 15 bp, Homo sapiens
taatctagtccctca

SEQ ID NO: 55860 - DNA, 15 bp, Homo sapiens
aatctagtccctcaa

SEQ ID NO: 55861 - DNA, 15 bp, Homo sapiens
atctagtccctcaaa

SEQ ID NO: 55862 - DNA, 15 bp, Homo sapiens
tctagtccctcaaac

SEQ ID NO: 55863 - DNA, 15 bp, Homo sapiens
ctagtccctcaaact

SEQ ID NO: 55864 - DNA, 15 bp, Homo sapiens
tagtccctcaaactg

SEQ ID NO: 55865 - DNA, 15 bp, Homo sapiens
agtccctcaaactgt

SEQ ID NO: 55866 - DNA, 15 bp, Homo sapiens
gtccctcaaactgtg

SEQ ID NO: 55867 - DNA, 15 bp, Homo sapiens
tccctcaaactgtgc

SEQ ID NO: 55868 - DNA, 15 bp, Homo sapiens
ccctcaaactgtgca

SEQ ID NO: 55869 - DNA, 15 bp, Homo sapiens
cctcaaactgtgcag

SEQ ID NO: 55870 - DNA, 15 bp, Homo sapiens
ctcaaactgtgcagc

SEQ ID NO: 55871 - DNA, 15 bp, Homo sapiens
tcaaactgtgcagcc

SEQ ID NO: 55872 - DNA, 15 bp, Homo sapiens
caaactgtgcagcct

SEQ ID NO: 55873 - DNA, 15 bp, Homo sapiens
aaactgtgcagcctt

SEQ ID NO: 55874 - DNA, 15 bp, Homo sapiens
aactgtgcagcctta

SEQ ID NO: 55875 - DNA, 15 bp, Homo sapiens
actgtgcagccttac

SEQ ID NO: 55876 - DNA, 15 bp, Homo sapiens
ctgtgcagccttaca

SEQ ID NO: 55877 - DNA, 15 bp, Homo sapiens
tgtgcagccttacat

SEQ ID NO: 55878 - DNA, 15 bp, Homo sapiens
gtgcagccttacatg

SEQ ID NO: 55879 - DNA, 15 bp, Homo sapiens
tgcagccttacatgg

SEQ ID NO: 55880 - DNA, 15 bp, Homo sapiens
gcagccttacatgga

SEQ ID NO: 55881 - DNA, 15 bp, Homo sapiens
cagccttacatggag

SEQ ID NO: 55882 - DNA, 15 bp, Homo sapiens
agccttacatggagt

SEQ ID NO: 55883 - DNA, 15 bp, Homo sapiens
gccttacatggagta

SEQ ID NO: 55884 - DNA, 15 bp, Homo sapiens
ccttacatggagtac

SEQ ID NO: 55885 - DNA, 15 bp, Homo sapiens
cttacatggagtaca

SEQ ID NO: 55886 - DNA, 15 bp, Homo sapiens
ttacatggagtacac

SEQ ID NO: 55887 - DNA, 15 bp, Homo sapiens
tacatggagtacaca

SEQ ID NO: 55888 - DNA, 15 bp, Homo sapiens
acatggagtacacac

SEQ ID NO: 55889 - DNA, 15 bp, Homo sapiens
catggagtacacaca

SEQ ID NO: 55890 - DNA, 15 bp, Homo sapiens
atggagtacacacac

SEQ ID NO: 55891 - DNA, 15 bp, Homo sapiens
tggagtacacacaca

SEQ ID NO: 55892 - DNA, 15 bp, Homo sapiens
ggagtacacacacac

SEQ ID NO: 55893 - DNA, 15 bp, Homo sapiens
gagtacacacacact

SEQ ID NO: 55894 - DNA, 15 bp, Homo sapiens
agtacacacacactt

SEQ ID NO: 55895 - DNA, 15 bp, Homo sapiens
gtacacacacacttg

SEQ ID NO: 55896 - DNA, 15 bp, Homo sapiens
tacacacacacttgc

SEQ ID NO: 55897 - DNA, 15 bp, Homo sapiens
acacacacacttgca

SEQ ID NO: 55898 - DNA, 15 bp, Homo sapiens
cacacacacttgcag

SEQ ID NO: 55899 - DNA, 15 bp, Homo sapiens
acacacacttgcagc

SEQ ID NO: 55900 - DNA, 15 bp, Homo sapiens
cacacacttgcagcc

SEQ ID NO: 55901 - DNA, 15 bp, Homo sapiens
acacacttgcagcct

SEQ ID NO: 55902 - DNA, 15 bp, Homo sapiens
cacacttgcagcctt

SEQ ID NO: 55903 - DNA, 15 bp, Homo sapiens
acacttgcagccttg

SEQ ID NO: 55904 - DNA, 15 bp, Homo sapiens
cacttgcagccttga

SEQ ID NO: 55905 - DNA, 15 bp, Homo sapiens
acttgcagccttgaa

SEQ ID NO: 55906 - DNA, 15 bp, Homo sapiens
cttgcagccttgaag

SEQ ID NO: 55907 - DNA, 15 bp, Homo sapiens
ttgcagccttgaagt

SEQ ID NO: 55908 - DNA, 15 bp, Homo sapiens
tgcagccttgaagta

SEQ ID NO: 55909 - DNA, 15 bp, Homo sapiens
gcagccttgaagtac

SEQ ID NO: 55910 - DNA, 15 bp, Homo sapiens
cagccttgaagtact

SEQ ID NO: 55911 - DNA, 15 bp, Homo sapiens
agccttgaagtacta

SEQ ID NO: 55912 - DNA, 15 bp, Homo sapiens
gccttgaagtactac

SEQ ID NO: 55913 - DNA, 15 bp, Homo sapiens
ccttgaagtactacc

SEQ ID NO: 55914 - DNA, 15 bp, Homo sapiens
cttgaagtactaccc

SEQ ID NO: 55915 - DNA, 15 bp, Homo sapiens
ttgaagtactaccca

SEQ ID NO: 55916 - DNA, 15 bp, Homo sapiens
tgaagtactacccac

SEQ ID NO: 55917 - DNA, 15 bp, Homo sapiens
gaagtactacccact

SEQ ID NO: 55918 - DNA, 15 bp, Homo sapiens
aagtactacccactg

SEQ ID NO: 55919 - DNA, 15 bp, Homo sapiens
agtactacccactga

SEQ ID NO: 55920 - DNA, 15 bp, Homo sapiens
gtactacccactgag

SEQ ID NO: 55921 - DNA, 15 bp, Homo sapiens
tactacccactgagg

SEQ ID NO: 55922 - DNA, 15 bp, Homo sapiens
actacccactgaggg

SEQ ID NO: 55923 - DNA, 15 bp, Homo sapiens
ctacccactgagggg

SEQ ID NO: 55924 - DNA, 15 bp, Homo sapiens
tacccactgagggga

SEQ ID NO: 55925 - DNA, 15 bp, Homo sapiens
acccactgaggggag

SEQ ID NO: 55926 - DNA, 15 bp, Homo sapiens
cccactgaggggaga

SEQ ID NO: 55927 - DNA, 15 bp, Homo sapiens
ccactgaggggagaa

SEQ ID NO: 55928 - DNA, 15 bp, Homo sapiens
cactgaggggagaag

SEQ ID NO: 55929 - DNA, 15 bp, Homo sapiens
actgaggggagaagg

SEQ ID NO: 55930 - DNA, 15 bp, Homo sapiens
ctgaggggagaaggc

SEQ ID NO: 55931 - DNA, 15 bp, Homo sapiens
tgaggggagaaggca

SEQ ID NO: 55932 - DNA, 15 bp, Homo sapiens
gaggggagaaggcac

SEQ ID NO: 55933 - DNA, 15 bp, Homo sapiens
aggggagaaggcacg

SEQ ID NO: 55934 - DNA, 15 bp, Homo sapiens
ggggagaaggcacgg

SEQ ID NO: 55935 - DNA, 15 bp, Homo sapiens
gggagaaggcacggc

SEQ ID NO: 55936 - DNA, 15 bp, Homo sapiens
ggagaaggcacggca

SEQ ID NO: 55937 - DNA, 15 bp, Homo sapiens
gagaaggcacggcaa

SEQ ID NO: 55938 - DNA, 15 bp, Homo sapiens
agaaggcacggcaag

SEQ ID NO: 55939 - DNA, 15 bp, Homo sapiens
gaaggcacggcaagg

SEQ ID NO: 55940 - DNA, 15 bp, Homo sapiens
aaggcacggcaaggg

SEQ ID NO: 55941 - DNA, 15 bp, Homo sapiens
aggcacggcaagggg

SEQ ID NO: 55942 - DNA, 15 bp, Homo sapiens
ggcacggcaagggga

SEQ ID NO: 55943 - DNA, 15 bp, Homo sapiens
gcacggcaaggggaa

SEQ ID NO: 55944 - DNA, 15 bp, Homo sapiens
cacggcaaggggaaa

SEQ ID NO: 55945 - DNA, 15 bp, Homo sapiens
acggcaaggggaaag

SEQ ID NO: 55946 - DNA, 15 bp, Homo sapiens
cggcaaggggaaagg

SEQ ID NO: 55947 - DNA, 15 bp, Homo sapiens
ggcaaggggaaaggt

SEQ ID NO: 55948 - DNA, 15 bp, Homo sapiens
gcaaggggaaaggtt

SEQ ID NO: 55949 - DNA, 15 bp, Homo sapiens
caaggggaaaggttg

SEQ ID NO: 55950 - DNA, 15 bp, Homo sapiens
aaggggaaaggttgg

SEQ ID NO: 55951 - DNA, 15 bp, Homo sapiens
aggggaaaggttggc

SEQ ID NO: 55952 - DNA, 15 bp, Homo sapiens
ggggaaaggttggca

SEQ ID NO: 55953 - DNA, 15 bp, Homo sapiens
gggaaaggttggcac

SEQ ID NO: 55954 - DNA, 15 bp, Homo sapiens
ggaaaggttggcaca

SEQ ID NO: 55955 - DNA, 15 bp, Homo sapiens
gaaaggttggcacag

SEQ ID NO: 55956 - DNA, 15 bp, Homo sapiens
aaaggttggcacagg

SEQ ID NO: 55957 - DNA, 15 bp, Homo sapiens
aaggttggcacagga

SEQ ID NO: 55958 - DNA, 15 bp, Homo sapiens
aggttggcacaggat

SEQ ID NO: 55959 - DNA, 15 bp, Homo sapiens
ggttggcacaggatg

SEQ ID NO: 55960 - DNA, 15 bp, Homo sapiens
gttggcacaggatgg

SEQ ID NO: 55961 - DNA, 15 bp, Homo sapiens
ttggcacaggatgga

SEQ ID NO: 55962 - DNA, 15 bp, Homo sapiens
tggcacaggatggag

SEQ ID NO: 55963 - DNA, 15 bp, Homo sapiens
ggcacaggatggagc

SEQ ID NO: 55964 - DNA, 15 bp, Homo sapiens
gcacaggatggagca

SEQ ID NO: 55965 - DNA, 15 bp, Homo sapiens
cacaggatggagcaa

SEQ ID NO: 55966 - DNA, 15 bp, Homo sapiens
acaggatggagcaag

SEQ ID NO: 55967 - DNA, 15 bp, Homo sapiens
caggatggagcaagt

SEQ ID NO: 55968 - DNA, 15 bp, Homo sapiens
aggatggagcaagtg

SEQ ID NO: 55969 - DNA, 15 bp, Homo sapiens
ggatggagcaagtgc

SEQ ID NO: 55970 - DNA, 15 bp, Homo sapiens
gatggagcaagtgct

SEQ ID NO: 55971 - DNA, 15 bp, Homo sapiens
atggagcaagtgctt

SEQ ID NO: 55972 - DNA, 15 bp, Homo sapiens
tggagcaagtgcttt

SEQ ID NO: 55973 - DNA, 15 bp, Homo sapiens
ggagcaagtgctttt

SEQ ID NO: 55974 - DNA, 15 bp, Homo sapiens
gagcaagtgcttttt

SEQ ID NO: 55975 - DNA, 15 bp, Homo sapiens
agcaagtgctttttc

SEQ ID NO: 55976 - DNA, 15 bp, Homo sapiens
gcaagtgctttttct

SEQ ID NO: 55977 - DNA, 15 bp, Homo sapiens
caagtgctttttctc

SEQ ID NO: 55978 - DNA, 15 bp, Homo sapiens
aagtgctttttctca

SEQ ID NO: 55979 - DNA, 15 bp, Homo sapiens
agtgctttttctcac

SEQ ID NO: 55980 - DNA, 15 bp, Homo sapiens
gtgctttttctcaca

SEQ ID NO: 55981 - DNA, 15 bp, Homo sapiens
tgctttttctcacac

SEQ ID NO: 55982 - DNA, 15 bp, Homo sapiens
gctttttctcacaca

SEQ ID NO: 55983 - DNA, 15 bp, Homo sapiens
ctttttctcacacat

SEQ ID NO: 55984 - DNA, 15 bp, Homo sapiens
tttttctcacacatt

SEQ ID NO: 55985 - DNA, 15 bp, Homo sapiens
ttttctcacacattc

SEQ ID NO: 55986 - DNA, 15 bp, Homo sapiens
tttctcacacattct

SEQ ID NO: 55987 - DNA, 15 bp, Homo sapiens
ttctcacacattctg

SEQ ID NO: 55988 - DNA, 15 bp, Homo sapiens
tctcacacattctgg

SEQ ID NO: 55989 - DNA, 15 bp, Homo sapiens
ctcacacattctgga

SEQ ID NO: 55990 - DNA, 15 bp, Homo sapiens
tcacacattctggag

SEQ ID NO: 55991 - DNA, 15 bp, Homo sapiens
cacacattctggagg

SEQ ID NO: 55992 - DNA, 15 bp, Homo sapiens
acacattctggagga

SEQ ID NO: 55993 - DNA, 15 bp, Homo sapiens
cacattctggaggaa

SEQ ID NO: 55994 - DNA, 15 bp, Homo sapiens
acattctggaggaaa

SEQ ID NO: 55995 - DNA, 15 bp, Homo sapiens
cattctggaggaaaa

SEQ ID NO: 55996 - DNA, 15 bp, Homo sapiens
attctggaggaaaag

SEQ ID NO: 55997 - DNA, 15 bp, Homo sapiens
ttctggaggaaaagt

SEQ ID NO: 55998 - DNA, 15 bp, Homo sapiens
tctggaggaaaagtt

SEQ ID NO: 55999 - DNA, 15 bp, Homo sapiens
ctggaggaaaagtta

SEQ ID NO: 56000 - DNA, 15 bp, Homo sapiens
tggaggaaaagttat

SEQ ID NO: 56001 - DNA, 15 bp, Homo sapiens
ggaggaaaagttatc

SEQ ID NO: 56002 - DNA, 15 bp, Homo sapiens
gaggaaaagttatcc

SEQ ID NO: 56003 - DNA, 15 bp, Homo sapiens
aggaaaagttatcca

SEQ ID NO: 56004 - DNA, 15 bp, Homo sapiens
ggaaaagttatccag

SEQ ID NO: 56005 - DNA, 15 bp, Homo sapiens
gaaaagttatccagt

SEQ ID NO: 56006 - DNA, 15 bp, Homo sapiens
aaaagttatccagtt

SEQ ID NO: 56007 - DNA, 15 bp, Homo sapiens
aaagttatccagttc

SEQ ID NO: 56008 - DNA, 15 bp, Homo sapiens
aagttatccagttct

SEQ ID NO: 56009 - DNA, 15 bp, Homo sapiens
agttatccagttctt

SEQ ID NO: 56010 - DNA, 15 bp, Homo sapiens
gttatccagttcttc

SEQ ID NO: 56011 - DNA, 15 bp, Homo sapiens
ttatccagttcttct

SEQ ID NO: 56012 - DNA, 15 bp, Homo sapiens
tatccagttcttctg

SEQ ID NO: 56013 - DNA, 15 bp, Homo sapiens
atccagttcttctgt

SEQ ID NO: 56014 - DNA, 15 bp, Homo sapiens
tccagttcttctgtt

SEQ ID NO: 56015 - DNA, 15 bp, Homo sapiens
ccagttcttctgttc

SEQ ID NO: 56016 - DNA, 15 bp, Homo sapiens
cagttcttctgttct

SEQ ID NO: 56017 - DNA, 15 bp, Homo sapiens
agttcttctgttcta

SEQ ID NO: 56018 - DNA, 15 bp, Homo sapiens
gttcttctgttctag

SEQ ID NO: 56019 - DNA, 15 bp, Homo sapiens
ttcttctgttctaga

SEQ ID NO: 56020 - DNA, 15 bp, Homo sapiens
tcttctgttctagaa

SEQ ID NO: 56021 - DNA, 15 bp, Homo sapiens
cttctgttctagaaa

SEQ ID NO: 56022 - DNA, 15 bp, Homo sapiens
ttctgttctagaaac

SEQ ID NO: 56023 - DNA, 15 bp, Homo sapiens
tctgttctagaaaca

SEQ ID NO: 56024 - DNA, 15 bp, Homo sapiens
ctgttctagaaacac

SEQ ID NO: 56025 - DNA, 15 bp, Homo sapiens
tgttctagaaacacc

SEQ ID NO: 56026 - DNA, 15 bp, Homo sapiens
gttctagaaacaccc

SEQ ID NO: 56027 - DNA, 15 bp, Homo sapiens
ttctagaaacacccc

SEQ ID NO: 56028 - DNA, 15 bp, Homo sapiens
tctagaaacacccct

SEQ ID NO: 56029 - DNA, 15 bp, Homo sapiens
ctagaaacacccctg

SEQ ID NO: 56030 - DNA, 15 bp, Homo sapiens
tagaaacacccctgt

SEQ ID NO: 56031 - DNA, 15 bp, Homo sapiens
agaaacacccctgtc

SEQ ID NO: 56032 - DNA, 15 bp, Homo sapiens
gaaacacccctgtcc

SEQ ID NO: 56033 - DNA, 15 bp, Homo sapiens
aaacacccctgtcct

SEQ ID NO: 56034 - DNA, 15 bp, Homo sapiens
aacacccctgtcctt

SEQ ID NO: 56035 - DNA, 15 bp, Homo sapiens
acacccctgtccttc

SEQ ID NO: 56036 - DNA, 15 bp, Homo sapiens
cacccctgtccttca

SEQ ID NO: 56037 - DNA, 15 bp, Homo sapiens
acccctgtccttcag

SEQ ID NO: 56038 - DNA, 15 bp, Homo sapiens
cccctgtccttcaga

SEQ ID NO: 56039 - DNA, 15 bp, Homo sapiens
ccctgtccttcagaa

SEQ ID NO: 56040 - DNA, 15 bp, Homo sapiens
cctgtccttcagaaa

SEQ ID NO: 56041 - DNA, 15 bp, Homo sapiens
ctgtccttcagaaac

SEQ ID NO: 56042 - DNA, 15 bp, Homo sapiens
tgtccttcagaaacc

SEQ ID NO: 56043 - DNA, 15 bp, Homo sapiens
gtccttcagaaacca

SEQ ID NO: 56044 - DNA, 15 bp, Homo sapiens
tccttcagaaaccag

SEQ ID NO: 56045 - DNA, 15 bp, Homo sapiens
ccttcagaaaccagg

SEQ ID NO: 56046 - DNA, 15 bp, Homo sapiens
cttcagaaaccaggg

SEQ ID NO: 56047 - DNA, 15 bp, Homo sapiens
ttcagaaaccagggt

SEQ ID NO: 56048 - DNA, 15 bp, Homo sapiens
tcagaaaccagggtc

SEQ ID NO: 56049 - DNA, 15 bp, Homo sapiens
cagaaaccagggtct

SEQ ID NO: 56050 - DNA, 15 bp, Homo sapiens
agaaaccagggtcta

SEQ ID NO: 56051 - DNA, 15 bp, Homo sapiens
gaaaccagggtctag

SEQ ID NO: 56052 - DNA, 15 bp, Homo sapiens
aaaccagggtctagt

SEQ ID NO: 56053 - DNA, 15 bp, Homo sapiens
aaccagggtctagtt

SEQ ID NO: 56054 - DNA, 15 bp, Homo sapiens
accagggtctagttg

SEQ ID NO: 56055 - DNA, 15 bp, Homo sapiens
ccagggtctagttgc

SEQ ID NO: 56056 - DNA, 15 bp, Homo sapiens
cagggtctagttgct

SEQ ID NO: 56057 - DNA, 15 bp, Homo sapiens
agggtctagttgctc

SEQ ID NO: 56058 - DNA, 15 bp, Homo sapiens
gggtctagttgctct

SEQ ID NO: 56059 - DNA, 15 bp, Homo sapiens
ggtctagttgctctg

SEQ ID NO: 56060 - DNA, 15 bp, Homo sapiens
gtctagttgctctgg

SEQ ID NO: 56061 - DNA, 15 bp, Homo sapiens
tctagttgctctggc

SEQ ID NO: 56062 - DNA, 15 bp, Homo sapiens
ctagttgctctggct

SEQ ID NO: 56063 - DNA, 15 bp, Homo sapiens
tagttgctctggcta

SEQ ID NO: 56064 - DNA, 15 bp, Homo sapiens
agttgctctggctac

SEQ ID NO: 56065 - DNA, 15 bp, Homo sapiens
gttgctctggctacc

SEQ ID NO: 56066 - DNA, 15 bp, Homo sapiens
ttgctctggctacca

SEQ ID NO: 56067 - DNA, 15 bp, Homo sapiens
tgctctggctaccag

SEQ ID NO: 56068 - DNA, 15 bp, Homo sapiens
gctctggctaccagg

SEQ ID NO: 56069 - DNA, 15 bp, Homo sapiens
ctctggctaccaggc

SEQ ID NO: 56070 - DNA, 15 bp, Homo sapiens
tctggctaccaggcg

SEQ ID NO: 56071 - DNA, 15 bp, Homo sapiens
ctggctaccaggcgt

SEQ ID NO: 56072 - DNA, 15 bp, Homo sapiens
tggctaccaggcgtg

SEQ ID NO: 56073 - DNA, 15 bp, Homo sapiens
ggctaccaggcgtga

SEQ ID NO: 56074 - DNA, 15 bp, Homo sapiens
gctaccaggcgtgag

SEQ ID NO: 56075 - DNA, 15 bp, Homo sapiens
ctaccaggcgtgagc

SEQ ID NO: 56076 - DNA, 15 bp, Homo sapiens
taccaggcgtgagca

SEQ ID NO: 56077 - DNA, 15 bp, Homo sapiens
accaggcgtgagcag

SEQ ID NO: 56078 - DNA, 15 bp, Homo sapiens
ccaggcgtgagcagg

SEQ ID NO: 56079 - DNA, 15 bp, Homo sapiens
caggcgtgagcaggt

SEQ ID NO: 56080 - DNA, 15 bp, Homo sapiens
aggcgtgagcaggtg

SEQ ID NO: 56081 - DNA, 15 bp, Homo sapiens
ggcgtgagcaggtgg

SEQ ID NO: 56082 - DNA, 15 bp, Homo sapiens
gcgtgagcaggtggt

SEQ ID NO: 56083 - DNA, 15 bp, Homo sapiens
cgtgagcaggtggtg

SEQ ID NO: 56084 - DNA, 15 bp, Homo sapiens
gtgagcaggtggtgg

SEQ ID NO: 56085 - DNA, 15 bp, Homo sapiens
tgagcaggtggtggt

SEQ ID NO: 56086 - DNA, 15 bp, Homo sapiens
gagcaggtggtggta

SEQ ID NO: 56087 - DNA, 15 bp, Homo sapiens
agcaggtggtggtag

SEQ ID NO: 56088 - DNA, 15 bp, Homo sapiens
gcaggtggtggtagc

SEQ ID NO: 56089 - DNA, 15 bp, Homo sapiens
caggtggtggtagca

SEQ ID NO: 56090 - DNA, 15 bp, Homo sapiens
aggtggtggtagcac

SEQ ID NO: 56091 - DNA, 15 bp, Homo sapiens
ggtggtggtagcacc

SEQ ID NO: 56092 - DNA, 15 bp, Homo sapiens
gtggtggtagcacca

SEQ ID NO: 56093 - DNA, 15 bp, Homo sapiens
tggtggtagcaccac

SEQ ID NO: 56094 - DNA, 15 bp, Homo sapiens
ggtggtagcaccaca

SEQ ID NO: 56095 - DNA, 15 bp, Homo sapiens
gtggtagcaccacag

SEQ ID NO: 56096 - DNA, 15 bp, Homo sapiens
tggtagcaccacagg

SEQ ID NO: 56097 - DNA, 15 bp, Homo sapiens
ggtagcaccacaggc

SEQ ID NO: 56098 - DNA, 15 bp, Homo sapiens
gtagcaccacaggcc

SEQ ID NO: 56099 - DNA, 15 bp, Homo sapiens
tagcaccacaggccc

SEQ ID NO: 56100 - DNA, 15 bp, Homo sapiens
agcaccacaggcccc

SEQ ID NO: 56101 - DNA, 15 bp, Homo sapiens
gcaccacaggccccg

SEQ ID NO: 56102 - DNA, 15 bp, Homo sapiens
caccacaggccccgg

SEQ ID NO: 56103 - DNA, 15 bp, Homo sapiens
accacaggccccggt

SEQ ID NO: 56104 - DNA, 15 bp, Homo sapiens
ccacaggccccggtt

SEQ ID NO: 56105 - DNA, 15 bp, Homo sapiens
cacaggccccggtta

SEQ ID NO: 56106 - DNA, 15 bp, Homo sapiens
acaggccccggttac

SEQ ID NO: 56107 - DNA, 15 bp, Homo sapiens
caggccccggttacc

SEQ ID NO: 56108 - DNA, 15 bp, Homo sapiens
aggccccggttacca

SEQ ID NO: 56109 - DNA, 15 bp, Homo sapiens
ggccccggttaccat

SEQ ID NO: 56110 - DNA, 15 bp, Homo sapiens
gccccggttaccatc

SEQ ID NO: 56111 - DNA, 15 bp, Homo sapiens
ccccggttaccatca

SEQ ID NO: 56112 - DNA, 15 bp, Homo sapiens
cccggttaccatcac

SEQ ID NO: 56113 - DNA, 15 bp, Homo sapiens
ccggttaccatcact

SEQ ID NO: 56114 - DNA, 15 bp, Homo sapiens
cggttaccatcactg

SEQ ID NO: 56115 - DNA, 15 bp, Homo sapiens
ggttaccatcactgt

SEQ ID NO: 56116 - DNA, 15 bp, Homo sapiens
gttaccatcactgtc

SEQ ID NO: 56117 - DNA, 15 bp, Homo sapiens
ttaccatcactgtcc

SEQ ID NO: 56118 - DNA, 15 bp, Homo sapiens
taccatcactgtccc

SEQ ID NO: 56119 - DNA, 15 bp, Homo sapiens
accatcactgtccca

SEQ ID NO: 56120 - DNA, 15 bp, Homo sapiens
ccatcactgtcccat

SEQ ID NO: 56121 - DNA, 15 bp, Homo sapiens
catcactgtcccatg

SEQ ID NO: 56122 - DNA, 15 bp, Homo sapiens
atcactgtcccatgt

SEQ ID NO: 56123 - DNA, 15 bp, Homo sapiens
tcactgtcccatgtc

SEQ ID NO: 56124 - DNA, 15 bp, Homo sapiens
cactgtcccatgtct

SEQ ID NO: 56125 - DNA, 15 bp, Homo sapiens
actgtcccatgtctt

SEQ ID NO: 56126 - DNA, 15 bp, Homo sapiens
ctgtcccatgtcttt

SEQ ID NO: 56127 - DNA, 15 bp, Homo sapiens
tgtcccatgtctttg

SEQ ID NO: 56128 - DNA, 15 bp, Homo sapiens
gtcccatgtctttga

SEQ ID NO: 56129 - DNA, 15 bp, Homo sapiens
tcccatgtctttgat

SEQ ID NO: 56130 - DNA, 15 bp, Homo sapiens
cccatgtctttgatc

SEQ ID NO: 56131 - DNA, 15 bp, Homo sapiens
ccatgtctttgatct

SEQ ID NO: 56132 - DNA, 15 bp, Homo sapiens
catgtctttgatctt

SEQ ID NO: 56133 - DNA, 15 bp, Homo sapiens
atgtctttgatcttc

SEQ ID NO: 56134 - DNA, 15 bp, Homo sapiens
tgtctttgatcttcg

SEQ ID NO: 56135 - DNA, 15 bp, Homo sapiens
gtctttgatcttcgt

SEQ ID NO: 56136 - DNA, 15 bp, Homo sapiens
tctttgatcttcgtc

SEQ ID NO: 56137 - DNA, 15 bp, Homo sapiens
ctttgatcttcgtcc

SEQ ID NO: 56138 - DNA, 15 bp, Homo sapiens
tttgatcttcgtcct

SEQ ID NO: 56139 - DNA, 15 bp, Homo sapiens
ttgatcttcgtcctt

SEQ ID NO: 56140 - DNA, 15 bp, Homo sapiens
tgatcttcgtccttg

SEQ ID NO: 56141 - DNA, 15 bp, Homo sapiens
gatcttcgtccttgt

SEQ ID NO: 56142 - DNA, 15 bp, Homo sapiens
atcttcgtccttgtg

SEQ ID NO: 56143 - DNA, 15 bp, Homo sapiens
tcttcgtccttgtgg

SEQ ID NO: 56144 - DNA, 15 bp, Homo sapiens
cttcgtccttgtggg

SEQ ID NO: 56145 - DNA, 15 bp, Homo sapiens
ttcgtccttgtgggg

SEQ ID NO: 56146 - DNA, 15 bp, Homo sapiens
tcgtccttgtgggga

SEQ ID NO: 56147 - DNA, 15 bp, Homo sapiens
cgtccttgtggggac

SEQ ID NO: 56148 - DNA, 15 bp, Homo sapiens
gtccttgtggggact

SEQ ID NO: 56149 - DNA, 15 bp, Homo sapiens
tccttgtggggactg

SEQ ID NO: 56150 - DNA, 15 bp, Homo sapiens
ccttgtggggactgg

SEQ ID NO: 56151 - DNA, 15 bp, Homo sapiens
cttgtggggactggc

SEQ ID NO: 56152 - DNA, 15 bp, Homo sapiens
ttgtggggactggcc

SEQ ID NO: 56153 - DNA, 15 bp, Homo sapiens
tgtggggactggcct

SEQ ID NO: 56154 - DNA, 15 bp, Homo sapiens
gtggggactggcctg

SEQ ID NO: 56155 - DNA, 15 bp, Homo sapiens
tggggactggcctgc

SEQ ID NO: 56156 - DNA, 15 bp, Homo sapiens
ggggactggcctgca

SEQ ID NO: 56157 - DNA, 15 bp, Homo sapiens
gggactggcctgcat

SEQ ID NO: 56158 - DNA, 15 bp, Homo sapiens
ggactggcctgcatg

SEQ ID NO: 56159 - DNA, 15 bp, Homo sapiens
gactggcctgcatgg

SEQ ID NO: 56160 - DNA, 15 bp, Homo sapiens
actggcctgcatggc

SEQ ID NO: 56161 - DNA, 15 bp, Homo sapiens
ctggcctgcatggcc

SEQ ID NO: 56162 - DNA, 15 bp, Homo sapiens
tggcctgcatggcct

SEQ ID NO: 56163 - DNA, 15 bp, Homo sapiens
ggcctgcatggcctc

SEQ ID NO: 56164 - DNA, 15 bp, Homo sapiens
gcctgcatggcctcg

SEQ ID NO: 56165 - DNA, 15 bp, Homo sapiens
cctgcatggcctcgg

SEQ ID NO: 56166 - DNA, 15 bp, Homo sapiens
ctgcatggcctcggt

SEQ ID NO: 56167 - DNA, 15 bp, Homo sapiens
tgcatggcctcggtg

SEQ ID NO: 56168 - DNA, 15 bp, Homo sapiens
gcatggcctcggtgg

SEQ ID NO: 56169 - DNA, 15 bp, Homo sapiens
catggcctcggtggc

SEQ ID NO: 56170 - DNA, 15 bp, Homo sapiens
atggcctcggtggca

SEQ ID NO: 56171 - DNA, 15 bp, Homo sapiens
tggcctcggtggcag

SEQ ID NO: 56172 - DNA, 15 bp, Homo sapiens
ggcctcggtggcagc

SEQ ID NO: 56173 - DNA, 15 bp, Homo sapiens
gcctcggtggcagcg

SEQ ID NO: 56174 - DNA, 15 bp, Homo sapiens
cctcggtggcagcga

SEQ ID NO: 56175 - DNA, 15 bp, Homo sapiens
ctcggtggcagcgag

SEQ ID NO: 56176 - DNA, 15 bp, Homo sapiens
tcggtggcagcgagc

SEQ ID NO: 56177 - DNA, 15 bp, Homo sapiens
cggtggcagcgagcc

SEQ ID NO: 56178 - DNA, 15 bp, Homo sapiens
ggtggcagcgagccc

SEQ ID NO: 56179 - DNA, 15 bp, Homo sapiens
gtggcagcgagccct

SEQ ID NO: 56180 - DNA, 15 bp, Homo sapiens
tggcagcgagccctg

SEQ ID NO: 56181 - DNA, 15 bp, Homo sapiens
ggcagcgagccctgc

SEQ ID NO: 56182 - DNA, 15 bp, Homo sapiens
gcagcgagccctgca

SEQ ID NO: 56183 - DNA, 15 bp, Homo sapiens
cagcgagccctgcag

SEQ ID NO: 56184 - DNA, 15 bp, Homo sapiens
agcgagccctgcaga

SEQ ID NO: 56185 - DNA, 15 bp, Homo sapiens
gcgagccctgcagag

SEQ ID NO: 56186 - DNA, 15 bp, Homo sapiens
cgagccctgcagagg

SEQ ID NO: 56187 - DNA, 15 bp, Homo sapiens
gagccctgcagaggc

SEQ ID NO: 56188 - DNA, 15 bp, Homo sapiens
agccctgcagaggca

SEQ ID NO: 56189 - DNA, 15 bp, Homo sapiens
gccctgcagaggcaa

SEQ ID NO: 56190 - DNA, 15 bp, Homo sapiens
ccctgcagaggcaag

SEQ ID NO: 56191 - DNA, 15 bp, Homo sapiens
cctgcagaggcaagt

SEQ ID NO: 56192 - DNA, 15 bp, Homo sapiens
ctgcagaggcaagtg

SEQ ID NO: 56193 - DNA, 15 bp, Homo sapiens
tgcagaggcaagtgc

SEQ ID NO: 56194 - DNA, 15 bp, Homo sapiens
gcagaggcaagtgca

SEQ ID NO: 56195 - DNA, 15 bp, Homo sapiens
cagaggcaagtgcat

SEQ ID NO: 56196 - DNA, 15 bp, Homo sapiens
agaggcaagtgcatc

SEQ ID NO: 56197 - DNA, 15 bp, Homo sapiens
gaggcaagtgcatca

SEQ ID NO: 56198 - DNA, 15 bp, Homo sapiens
aggcaagtgcatcag

SEQ ID NO: 56199 - DNA, 15 bp, Homo sapiens
ggcaagtgcatcagc

SEQ ID NO: 56200 - DNA, 15 bp, Homo sapiens
gcaagtgcatcagca

SEQ ID NO: 56201 - DNA, 15 bp, Homo sapiens
caagtgcatcagcat

SEQ ID NO: 56202 - DNA, 15 bp, Homo sapiens
aagtgcatcagcatc

SEQ ID NO: 56203 - DNA, 15 bp, Homo sapiens
agtgcatcagcatca

SEQ ID NO: 56204 - DNA, 15 bp, Homo sapiens
gtgcatcagcatcac

SEQ ID NO: 56205 - DNA, 15 bp, Homo sapiens
tgcatcagcatcact

SEQ ID NO: 56206 - DNA, 15 bp, Homo sapiens
gcatcagcatcactg

SEQ ID NO: 56207 - DNA, 15 bp, Homo sapiens
catcagcatcactgt

SEQ ID NO: 56208 - DNA, 15 bp, Homo sapiens
atcagcatcactgtg

SEQ ID NO: 56209 - DNA, 15 bp, Homo sapiens
tcagcatcactgtgt

SEQ ID NO: 56210 - DNA, 15 bp, Homo sapiens
cagcatcactgtgtt

SEQ ID NO: 56211 - DNA, 15 bp, Homo sapiens
agcatcactgtgttt

SEQ ID NO: 56212 - DNA, 15 bp, Homo sapiens
gcatcactgtgtttg

SEQ ID NO: 56213 - DNA, 15 bp, Homo sapiens
catcactgtgtttgt

SEQ ID NO: 56214 - DNA, 15 bp, Homo sapiens
atcactgtgtttgtt

SEQ ID NO: 56215 - DNA, 15 bp, Homo sapiens
tcactgtgtttgttc

SEQ ID NO: 56216 - DNA, 15 bp, Homo sapiens
cactgtgtttgttcc

SEQ ID NO: 56217 - DNA, 15 bp, Homo sapiens
actgtgtttgttccc

SEQ ID NO: 56218 - DNA, 15 bp, Homo sapiens
ctgtgtttgttccca

SEQ ID NO: 56219 - DNA, 15 bp, Homo sapiens
tgtgtttgttcccag

SEQ ID NO: 56220 - DNA, 15 bp, Homo sapiens
gtgtttgttcccagg

SEQ ID NO: 56221 - DNA, 15 bp, Homo sapiens
tgtttgttcccaggt

SEQ ID NO: 56222 - DNA, 15 bp, Homo sapiens
gtttgttcccaggtt

SEQ ID NO: 56223 - DNA, 15 bp, Homo sapiens
tttgttcccaggtta

SEQ ID NO: 56224 - DNA, 15 bp, Homo sapiens
ttgttcccaggttac

SEQ ID NO: 56225 - DNA, 15 bp, Homo sapiens
tgttcccaggttacg

SEQ ID NO: 56226 - DNA, 15 bp, Homo sapiens
gttcccaggttacgt

SEQ ID NO: 56227 - DNA, 15 bp, Homo sapiens
ttcccaggttacgtc

SEQ ID NO: 56228 - DNA, 15 bp, Homo sapiens
tcccaggttacgtcg

SEQ ID NO: 56229 - DNA, 15 bp, Homo sapiens
cccaggttacgtcgg

SEQ ID NO: 56230 - DNA, 15 bp, Homo sapiens
ccaggttacgtcggc

SEQ ID NO: 56231 - DNA, 15 bp, Homo sapiens
caggttacgtcggcg

SEQ ID NO: 56232 - DNA, 15 bp, Homo sapiens
aggttacgtcggcgc

SEQ ID NO: 56233 - DNA, 15 bp, Homo sapiens
ggttacgtcggcgct

SEQ ID NO: 56234 - DNA, 15 bp, Homo sapiens
gttacgtcggcgctg

SEQ ID NO: 56235 - DNA, 15 bp, Homo sapiens
ttacgtcggcgctgc

SEQ ID NO: 56236 - DNA, 15 bp, Homo sapiens
tacgtcggcgctgct

SEQ ID NO: 56237 - DNA, 15 bp, Homo sapiens
acgtcggcgctgcta

SEQ ID NO: 56238 - DNA, 15 bp, Homo sapiens
cgtcggcgctgctac

SEQ ID NO: 56239 - DNA, 15 bp, Homo sapiens
gtcggcgctgctacc

SEQ ID NO: 56240 - DNA, 15 bp, Homo sapiens
tcggcgctgctaccg

SEQ ID NO: 56241 - DNA, 15 bp, Homo sapiens
cggcgctgctaccgt

SEQ ID NO: 56242 - DNA, 15 bp, Homo sapiens
ggcgctgctaccgtg

SEQ ID NO: 56243 - DNA, 15 bp, Homo sapiens
gcgctgctaccgtgg

SEQ ID NO: 56244 - DNA, 15 bp, Homo sapiens
cgctgctaccgtggg

SEQ ID NO: 56245 - DNA, 15 bp, Homo sapiens
gctgctaccgtgggt

SEQ ID NO: 56246 - DNA, 15 bp, Homo sapiens
ctgctaccgtgggtg

SEQ ID NO: 56247 - DNA, 15 bp, Homo sapiens
tgctaccgtgggtgc

SEQ ID NO: 56248 - DNA, 15 bp, Homo sapiens
gctaccgtgggtgct

SEQ ID NO: 56249 - DNA, 15 bp, Homo sapiens
ctaccgtgggtgctg

SEQ ID NO: 56250 - DNA, 15 bp, Homo sapiens
taccgtgggtgctgc

SEQ ID NO: 56251 - DNA, 15 bp, Homo sapiens
accgtgggtgctgct

SEQ ID NO: 56252 - DNA, 15 bp, Homo sapiens
ccgtgggtgctgctg

SEQ ID NO: 56253 - DNA, 15 bp, Homo sapiens
cgtgggtgctgctgc

SEQ ID NO: 56254 - DNA, 15 bp, Homo sapiens
gtgggtgctgctgca

SEQ ID NO: 56255 - DNA, 15 bp, Homo sapiens
tgggtgctgctgcat

SEQ ID NO: 56256 - DNA, 15 bp, Homo sapiens
gggtgctgctgcatg

SEQ ID NO: 56257 - DNA, 15 bp, Homo sapiens
ggtgctgctgcatgg

SEQ ID NO: 56258 - DNA, 15 bp, Homo sapiens
gtgctgctgcatggt

SEQ ID NO: 56259 - DNA, 15 bp, Homo sapiens
tgctgctgcatggtg

SEQ ID NO: 56260 - DNA, 15 bp, Homo sapiens
gctgctgcatggtgg

SEQ ID NO: 56261 - DNA, 15 bp, Homo sapiens
ctgctgcatggtggt

SEQ ID NO: 56262 - DNA, 15 bp, Homo sapiens
tgctgcatggtggtt

SEQ ID NO: 56263 - DNA, 15 bp, Homo sapiens
gctgcatggtggttc

SEQ ID NO: 56264 - DNA, 15 bp, Homo sapiens
ctgcatggtggttca

SEQ ID NO: 56265 - DNA, 15 bp, Homo sapiens
tgcatggtggttcat

SEQ ID NO: 56266 - DNA, 15 bp, Homo sapiens
gcatggtggttcatt

SEQ ID NO: 56267 - DNA, 15 bp, Homo sapiens
catggtggttcattg

SEQ ID NO: 56268 - DNA, 15 bp, Homo sapiens
atggtggttcattgc

SEQ ID NO: 56269 - DNA, 15 bp, Homo sapiens
tggtggttcattgct

SEQ ID NO: 56270 - DNA, 15 bp, Homo sapiens
ggtggttcattgctg

SEQ ID NO: 56271 - DNA, 15 bp, Homo sapiens
gtggttcattgctgc

SEQ ID NO: 56272 - DNA, 15 bp, Homo sapiens
tggttcattgctgct

SEQ ID NO: 56273 - DNA, 15 bp, Homo sapiens
ggttcattgctgctg

SEQ ID NO: 56274 - DNA, 15 bp, Homo sapiens
gttcattgctgctga

SEQ ID NO: 56275 - DNA, 15 bp, Homo sapiens
ttcattgctgctgac

SEQ ID NO: 56276 - DNA, 15 bp, Homo sapiens
tcattgctgctgacg

SEQ ID NO: 56277 - DNA, 15 bp, Homo sapiens
cattgctgctgacgg

SEQ ID NO: 56278 - DNA, 15 bp, Homo sapiens
attgctgctgacggt

SEQ ID NO: 56279 - DNA, 15 bp, Homo sapiens
ttgctgctgacggtg

SEQ ID NO: 56280 - DNA, 15 bp, Homo sapiens
tgctgctgacggtgg

SEQ ID NO: 56281 - DNA, 15 bp, Homo sapiens
gctgctgacggtggt

SEQ ID NO: 56282 - DNA, 15 bp, Homo sapiens
ctgctgacggtggtc

SEQ ID NO: 56283 - DNA, 15 bp, Homo sapiens
tgctgacggtggtcc

SEQ ID NO: 56284 - DNA, 15 bp, Homo sapiens
gctgacggtggtcca

SEQ ID NO: 56285 - DNA, 15 bp, Homo sapiens
ctgacggtggtccaa

SEQ ID NO: 56286 - DNA, 15 bp, Homo sapiens
tgacggtggtccaag

SEQ ID NO: 56287 - DNA, 15 bp, Homo sapiens
gacggtggtccaaga

SEQ ID NO: 56288 - DNA, 15 bp, Homo sapiens
acggtggtccaagag

SEQ ID NO: 56289 - DNA, 15 bp, Homo sapiens
cggtggtccaagagt

SEQ ID NO: 56290 - DNA, 15 bp, Homo sapiens
ggtggtccaagagtg

SEQ ID NO: 56291 - DNA, 15 bp, Homo sapiens
gtggtccaagagtgt

SEQ ID NO: 56292 - DNA, 15 bp, Homo sapiens
tggtccaagagtgtc

SEQ ID NO: 56293 - DNA, 15 bp, Homo sapiens
ggtccaagagtgtcc

SEQ ID NO: 56294 - DNA, 15 bp, Homo sapiens
gtccaagagtgtcct

SEQ ID NO: 56295 - DNA, 15 bp, Homo sapiens
tccaagagtgtcctt

SEQ ID NO: 56296 - DNA, 15 bp, Homo sapiens
ccaagagtgtccttc

SEQ ID NO: 56297 - DNA, 15 bp, Homo sapiens
caagagtgtccttct

SEQ ID NO: 56298 - DNA, 15 bp, Homo sapiens
aagagtgtccttcta

SEQ ID NO: 56299 - DNA, 15 bp, Homo sapiens
agagtgtccttctac

SEQ ID NO: 56300 - DNA, 15 bp, Homo sapiens
gagtgtccttctacc

SEQ ID NO: 56301 - DNA, 15 bp, Homo sapiens
agtgtccttctacca

SEQ ID NO: 56302 - DNA, 15 bp, Homo sapiens
gtgtccttctaccag

SEQ ID NO: 56303 - DNA, 15 bp, Homo sapiens
tgtccttctaccagc

SEQ ID NO: 56304 - DNA, 15 bp, Homo sapiens
gtccttctaccagct

SEQ ID NO: 56305 - DNA, 15 bp, Homo sapiens
tccttctaccagctg

SEQ ID NO: 56306 - DNA, 15 bp, Homo sapiens
ccttctaccagctgg

SEQ ID NO: 56307 - DNA, 15 bp, Homo sapiens
cttctaccagctggt

SEQ ID NO: 56308 - DNA, 15 bp, Homo sapiens
ttctaccagctggta

SEQ ID NO: 56309 - DNA, 15 bp, Homo sapiens
tctaccagctggtac

SEQ ID NO: 56310 - DNA, 15 bp, Homo sapiens
ctaccagctggtact

SEQ ID NO: 56311 - DNA, 15 bp, Homo sapiens
taccagctggtactc

SEQ ID NO: 56312 - DNA, 15 bp, Homo sapiens
accagctggtactca

SEQ ID NO: 56313 - DNA, 15 bp, Homo sapiens
ccagctggtactcag

SEQ ID NO: 56314 - DNA, 15 bp, Homo sapiens
cagctggtactcagt

SEQ ID NO: 56315 - DNA, 15 bp, Homo sapiens
agctggtactcagtc

SEQ ID NO: 56316 - DNA, 15 bp, Homo sapiens
gctggtactcagtca

SEQ ID NO: 56317 - DNA, 15 bp, Homo sapiens
ctggtactcagtcac

SEQ ID NO: 56318 - DNA, 15 bp, Homo sapiens
tggtactcagtcacc

SEQ ID NO: 56319 - DNA, 15 bp, Homo sapiens
ggtactcagtcacct

SEQ ID NO: 56320 - DNA, 15 bp, Homo sapiens
gtactcagtcacctt

SEQ ID NO: 56321 - DNA, 15 bp, Homo sapiens
tactcagtcaccttt

SEQ ID NO: 56322 - DNA, 15 bp, Homo sapiens
actcagtcacctttc

SEQ ID NO: 56323 - DNA, 15 bp, Homo sapiens
ctcagtcacctttct

SEQ ID NO: 56324 - DNA, 15 bp, Homo sapiens
tcagtcacctttctt

SEQ ID NO: 56325 - DNA, 15 bp, Homo sapiens
cagtcacctttcttt

SEQ ID NO: 56326 - DNA, 15 bp, Homo sapiens
agtcacctttctttc

SEQ ID NO: 56327 - DNA, 15 bp, Homo sapiens
gtcacctttctttct

SEQ ID NO: 56328 - DNA, 15 bp, Homo sapiens
tcacctttctttctg

SEQ ID NO: 56329 - DNA, 15 bp, Homo sapiens
cacctttctttctgt

SEQ ID NO: 56330 - DNA, 15 bp, Homo sapiens
acctttctttctgta

SEQ ID NO: 56331 - DNA, 15 bp, Homo sapiens
cctttctttctgtac

SEQ ID NO: 56332 - DNA, 15 bp, Homo sapiens
ctttctttctgtacc

SEQ ID NO: 56333 - DNA, 15 bp, Homo sapiens
tttctttctgtacct

SEQ ID NO: 56334 - DNA, 15 bp, Homo sapiens
ttctttctgtacctt

SEQ ID NO: 56335 - DNA, 15 bp, Homo sapiens
tctttctgtacctta

SEQ ID NO: 56336 - DNA, 15 bp, Homo sapiens
ctttctgtaccttac

SEQ ID NO: 56337 - DNA, 15 bp, Homo sapiens
tttctgtaccttaca

SEQ ID NO: 56338 - DNA, 15 bp, Homo sapiens
ttctgtaccttacat

SEQ ID NO: 56339 - DNA, 15 bp, Homo sapiens
tctgtaccttacatg

SEQ ID NO: 56340 - DNA, 15 bp, Homo sapiens
ctgtaccttacatga

SEQ ID NO: 56341 - DNA, 15 bp, Homo sapiens
tgtaccttacatgag

SEQ ID NO: 56342 - DNA, 15 bp, Homo sapiens
gtaccttacatgaga

SEQ ID NO: 56343 - DNA, 15 bp, Homo sapiens
taccttacatgagaa

SEQ ID NO: 56344 - DNA, 15 bp, Homo sapiens
accttacatgagaag

SEQ ID NO: 56345 - DNA, 15 bp, Homo sapiens
ccttacatgagaagt

SEQ ID NO: 56346 - DNA, 15 bp, Homo sapiens
cttacatgagaagtg

SEQ ID NO: 56347 - DNA, 15 bp, Homo sapiens
ttacatgagaagtgt

SEQ ID NO: 56348 - DNA, 15 bp, Homo sapiens
tacatgagaagtgtt

SEQ ID NO: 56349 - DNA, 15 bp, Homo sapiens
acatgagaagtgttg

SEQ ID NO: 56350 - DNA, 15 bp, Homo sapiens
catgagaagtgttgt

SEQ ID NO: 56351 - DNA, 15 bp, Homo sapiens
atgagaagtgttgtg

SEQ ID NO: 56352 - DNA, 15 bp, Homo sapiens
tgagaagtgttgtga

SEQ ID NO: 56353 - DNA, 15 bp, Homo sapiens
gagaagtgttgtgag

SEQ ID NO: 56354 - DNA, 15 bp, Homo sapiens
agaagtgttgtgagg

SEQ ID NO: 56355 - DNA, 15 bp, Homo sapiens
gaagtgttgtgaggc

SEQ ID NO: 56356 - DNA, 15 bp, Homo sapiens
aagtgttgtgaggcc

SEQ ID NO: 56357 - DNA, 15 bp, Homo sapiens
agtgttgtgaggcct

SEQ ID NO: 56358 - DNA, 15 bp, Homo sapiens
gtgttgtgaggcctt

SEQ ID NO: 56359 - DNA, 15 bp, Homo sapiens
tgttgtgaggccttg

SEQ ID NO: 56360 - DNA, 15 bp, Homo sapiens
gttgtgaggccttga

SEQ ID NO: 56361 - DNA, 15 bp, Homo sapiens
ttgtgaggccttgac

SEQ ID NO: 56362 - DNA, 15 bp, Homo sapiens
tgtgaggccttgacc

SEQ ID NO: 56363 - DNA, 15 bp, Homo sapiens
gtgaggccttgacct

SEQ ID NO: 56364 - DNA, 15 bp, Homo sapiens
tgaggccttgacctt

SEQ ID NO: 56365 - DNA, 15 bp, Homo sapiens
gaggccttgaccttt

SEQ ID NO: 56366 - DNA, 15 bp, Homo sapiens
aggccttgacctttc

SEQ ID NO: 56367 - DNA, 15 bp, Homo sapiens
ggccttgacctttct

SEQ ID NO: 56368 - DNA, 15 bp, Homo sapiens
gccttgacctttctg

SEQ ID NO: 56369 - DNA, 15 bp, Homo sapiens
ccttgacctttctgt

SEQ ID NO: 56370 - DNA, 15 bp, Homo sapiens
cttgacctttctgtg

SEQ ID NO: 56371 - DNA, 15 bp, Homo sapiens
ttgacctttctgtgg

SEQ ID NO: 56372 - DNA, 15 bp, Homo sapiens
tgacctttctgtggt

SEQ ID NO: 56373 - DNA, 15 bp, Homo sapiens
gacctttctgtggtt

SEQ ID NO: 56374 - DNA, 15 bp, Homo sapiens
acctttctgtggttt

SEQ ID NO: 56375 - DNA, 15 bp, Homo sapiens
cctttctgtggtttc

SEQ ID NO: 56376 - DNA, 15 bp, Homo sapiens
ctttctgtggtttcg

SEQ ID NO: 56377 - DNA, 15 bp, Homo sapiens
tttctgtggtttcgg

SEQ ID NO: 56378 - DNA, 15 bp, Homo sapiens
ttctgtggtttcggt

SEQ ID NO: 56379 - DNA, 15 bp, Homo sapiens
tctgtggtttcggta

SEQ ID NO: 56380 - DNA, 15 bp, Homo sapiens
ctgtggtttcggtat

SEQ ID NO: 56381 - DNA, 15 bp, Homo sapiens
tgtggtttcggtatc

SEQ ID NO: 56382 - DNA, 15 bp, Homo sapiens
gtggtttcggtatct

SEQ ID NO: 56383 - DNA, 15 bp, Homo sapiens
tggtttcggtatcta

SEQ ID NO: 56384 - DNA, 15 bp, Homo sapiens
ggtttcggtatctat

SEQ ID NO: 56385 - DNA, 15 bp, Homo sapiens
gtttcggtatctatc

SEQ ID NO: 56386 - DNA, 15 bp, Homo sapiens
tttcggtatctatca

SEQ ID NO: 56387 - DNA, 15 bp, Homo sapiens
ttcggtatctatcaa

SEQ ID NO: 56388 - DNA, 15 bp, Homo sapiens
tcggtatctatcaaa

SEQ ID NO: 56389 - DNA, 15 bp, Homo sapiens
cggtatctatcaaat

SEQ ID NO: 56390 - DNA, 15 bp, Homo sapiens
ggtatctatcaaatc

SEQ ID NO: 56391 - DNA, 15 bp, Homo sapiens
gtatctatcaaatca

SEQ ID NO: 56392 - DNA, 15 bp, Homo sapiens
tatctatcaaatcat

SEQ ID NO: 56393 - DNA, 15 bp, Homo sapiens
atctatcaaatcatc

SEQ ID NO: 56394 - DNA, 15 bp, Homo sapiens
tctatcaaatcatct

SEQ ID NO: 56395 - DNA, 15 bp, Homo sapiens
ctatcaaatcatctt

SEQ ID NO: 56396 - DNA, 15 bp, Homo sapiens
tatcaaatcatctta

SEQ ID NO: 56397 - DNA, 15 bp, Homo sapiens
atcaaatcatcttaa

SEQ ID NO: 56398 - DNA, 15 bp, Homo sapiens
tcaaatcatcttaag

SEQ ID NO: 56399 - DNA, 15 bp, Homo sapiens
caaatcatcttaaga

SEQ ID NO: 56400 - DNA, 15 bp, Homo sapiens
aaatcatcttaagac

SEQ ID NO: 56401 - DNA, 15 bp, Homo sapiens
aatcatcttaagact

SEQ ID NO: 56402 - DNA, 15 bp, Homo sapiens
atcatcttaagactc

SEQ ID NO: 56403 - DNA, 15 bp, Homo sapiens
tcatcttaagactca

SEQ ID NO: 56404 - DNA, 15 bp, Homo sapiens
catcttaagactcag

SEQ ID NO: 56405 - DNA, 15 bp, Homo sapiens
atcttaagactcaga

SEQ ID NO: 56406 - DNA, 15 bp, Homo sapiens
tcttaagactcagac

SEQ ID NO: 56407 - DNA, 15 bp, Homo sapiens
cttaagactcagaca

SEQ ID NO: 56408 - DNA, 15 bp, Homo sapiens
ttaagactcagacaa

SEQ ID NO: 56409 - DNA, 15 bp, Homo sapiens
taagactcagacaat

SEQ ID NO: 56410 - DNA, 15 bp, Homo sapiens
aagactcagacaata

SEQ ID NO: 56411 - DNA, 15 bp, Homo sapiens
agactcagacaataa

SEQ ID NO: 56412 - DNA, 15 bp, Homo sapiens
gactcagacaataaa

SEQ ID NO: 56413 - DNA, 15 bp, Homo sapiens
actcagacaataaac

SEQ ID NO: 56414 - DNA, 15 bp, Homo sapiens
ctcagacaataaaca

SEQ ID NO: 56415 - DNA, 15 bp, Homo sapiens
tcagacaataaacag

SEQ ID NO: 56416 - DNA, 15 bp, Homo sapiens
cagacaataaacagt

SEQ ID NO: 56417 - DNA, 15 bp, Homo sapiens
agacaataaacagtt

SEQ ID NO: 56418 - DNA, 15 bp, Homo sapiens
gacaataaacagtta

SEQ ID NO: 56419 - DNA, 15 bp, Homo sapiens
acaataaacagttac

SEQ ID NO: 56420 - DNA, 15 bp, Homo sapiens
caataaacagttaca

SEQ ID NO: 56421 - DNA, 15 bp, Homo sapiens
aataaacagttacat

SEQ ID NO: 56422 - DNA, 15 bp, Homo sapiens
ataaacagttacatc

SEQ ID NO: 56423 - DNA, 15 bp, Homo sapiens
taaacagttacatct

SEQ ID NO: 56424 - DNA, 15 bp, Homo sapiens
aaacagttacatcta

SEQ ID NO: 56425 - DNA, 15 bp, Homo sapiens
aacagttacatctaa

SEQ ID NO: 56426 - DNA, 15 bp, Homo sapiens
acagttacatctaag

SEQ ID NO: 56427 - DNA, 15 bp, Homo sapiens
cagttacatctaaga

SEQ ID NO: 56428 - DNA, 15 bp, Homo sapiens
agttacatctaagat

SEQ ID NO: 56429 - DNA, 15 bp, Homo sapiens
gttacatctaagatg

SEQ ID NO: 56430 - DNA, 15 bp, Homo sapiens
ttacatctaagatga

SEQ ID NO: 56431 - DNA, 15 bp, Homo sapiens
tacatctaagatgat

SEQ ID NO: 56432 - DNA, 15 bp, Homo sapiens
acatctaagatgatt

SEQ ID NO: 56433 - DNA, 15 bp, Homo sapiens
catctaagatgattc

SEQ ID NO: 56434 - DNA, 15 bp, Homo sapiens
atctaagatgattct

SEQ ID NO: 56435 - DNA, 15 bp, Homo sapiens
tctaagatgattctg

SEQ ID NO: 56436 - DNA, 15 bp, Homo sapiens
ctaagatgattctga

SEQ ID NO: 56437 - DNA, 15 bp, Homo sapiens
taagatgattctgaa

SEQ ID NO: 56438 - DNA, 15 bp, Homo sapiens
aagatgattctgaag

SEQ ID NO: 56439 - DNA, 15 bp, Homo sapiens
agatgattctgaagg

SEQ ID NO: 56440 - DNA, 15 bp, Homo sapiens
gatgattctgaagga

SEQ ID NO: 56441 - DNA, 15 bp, Homo sapiens
atgattctgaaggac

SEQ ID NO: 56442 - DNA, 15 bp, Homo sapiens
tgattctgaaggacc

SEQ ID NO: 56443 - DNA, 15 bp, Homo sapiens
gattctgaaggacca

SEQ ID NO: 56444 - DNA, 15 bp, Homo sapiens
attctgaaggaccag

SEQ ID NO: 56445 - DNA, 15 bp, Homo sapiens
ttctgaaggaccagg

SEQ ID NO: 56446 - DNA, 15 bp, Homo sapiens
tctgaaggaccaggg

SEQ ID NO: 56447 - DNA, 15 bp, Homo sapiens
ctgaaggaccagggc

SEQ ID NO: 56448 - DNA, 15 bp, Homo sapiens
tgaaggaccagggct

SEQ ID NO: 56449 - DNA, 15 bp, Homo sapiens
gaaggaccagggctt

SEQ ID NO: 56450 - DNA, 15 bp, Homo sapiens
aaggaccagggcttc

SEQ ID NO: 56451 - DNA, 15 bp, Homo sapiens
aggaccagggcttct

SEQ ID NO: 56452 - DNA, 15 bp, Homo sapiens
ggaccagggcttctc

SEQ ID NO: 56453 - DNA, 15 bp, Homo sapiens
gaccagggcttctcc

SEQ ID NO: 56454 - DNA, 15 bp, Homo sapiens
accagggcttctccg

SEQ ID NO: 56455 - DNA, 15 bp, Homo sapiens
ccagggcttctccga

SEQ ID NO: 56456 - DNA, 15 bp, Homo sapiens
cagggcttctccgag

SEQ ID NO: 56457 - DNA, 15 bp, Homo sapiens
agggcttctccgaga

SEQ ID NO: 56458 - DNA, 15 bp, Homo sapiens
gggcttctccgagaa

SEQ ID NO: 56459 - DNA, 15 bp, Homo sapiens
ggcttctccgagaaa

SEQ ID NO: 56460 - DNA, 15 bp, Homo sapiens
gcttctccgagaaat

SEQ ID NO: 56461 - DNA, 15 bp, Homo sapiens
cttctccgagaaatt

SEQ ID NO: 56462 - DNA, 15 bp, Homo sapiens
ttctccgagaaattg

SEQ ID NO: 56463 - DNA, 15 bp, Homo sapiens
tctccgagaaattgg

SEQ ID NO: 56464 - DNA, 15 bp, Homo sapiens
ctccgagaaattggg

SEQ ID NO: 56465 - DNA, 15 bp, Homo sapiens
tccgagaaattgggg

SEQ ID NO: 56466 - DNA, 15 bp, Homo sapiens
ccgagaaattggggt

SEQ ID NO: 56467 - DNA, 15 bp, Homo sapiens
cgagaaattggggta

SEQ ID NO: 56468 - DNA, 15 bp, Homo sapiens
gagaaattggggtaa

SEQ ID NO: 56469 - DNA, 15 bp, Homo sapiens
agaaattggggtaaa

SEQ ID NO: 56470 - DNA, 15 bp, Homo sapiens
gaaattggggtaaac

SEQ ID NO: 56471 - DNA, 15 bp, Homo sapiens
aaattggggtaaacc

SEQ ID NO: 56472 - DNA, 15 bp, Homo sapiens
aattggggtaaacct

SEQ ID NO: 56473 - DNA, 15 bp, Homo sapiens
attggggtaaacctc

SEQ ID NO: 56474 - DNA, 15 bp, Homo sapiens
ttggggtaaacctct

SEQ ID NO: 56475 - DNA, 15 bp, Homo sapiens
tggggtaaacctctt

SEQ ID NO: 56476 - DNA, 15 bp, Homo sapiens
ggggtaaacctcttg

SEQ ID NO: 56477 - DNA, 15 bp, Homo sapiens
gggtaaacctcttgg

SEQ ID NO: 56478 - DNA, 15 bp, Homo sapiens
ggtaaacctcttggc

SEQ ID NO: 56479 - DNA, 15 bp, Homo sapiens
gtaaacctcttggct

SEQ ID NO: 56480 - DNA, 15 bp, Homo sapiens
taaacctcttggctg

SEQ ID NO: 56481 - DNA, 15 bp, Homo sapiens
aaacctcttggctgg

SEQ ID NO: 56482 - DNA, 15 bp, Homo sapiens
aacctcttggctggc

SEQ ID NO: 56483 - DNA, 15 bp, Homo sapiens
acctcttggctggct

SEQ ID NO: 56484 - DNA, 15 bp, Homo sapiens
cctcttggctggctc

SEQ ID NO: 56485 - DNA, 15 bp, Homo sapiens
ctcttggctggctct

SEQ ID NO: 56486 - DNA, 15 bp, Homo sapiens
tcttggctggctctg

SEQ ID NO: 56487 - DNA, 15 bp, Homo sapiens
cttggctggctctgc

SEQ ID NO: 56488 - DNA, 15 bp, Homo sapiens
ttggctggctctgca

SEQ ID NO: 56489 - DNA, 15 bp, Homo sapiens
tggctggctctgcat

SEQ ID NO: 56490 - DNA, 15 bp, Homo sapiens
ggctggctctgcatt

SEQ ID NO: 56491 - DNA, 15 bp, Homo sapiens
gctggctctgcattc

SEQ ID NO: 56492 - DNA, 15 bp, Homo sapiens
ctggctctgcattca

SEQ ID NO: 56493 - DNA, 15 bp, Homo sapiens
tggctctgcattcag

SEQ ID NO: 56494 - DNA, 15 bp, Homo sapiens
ggctctgcattcagg

SEQ ID NO: 56495 - DNA, 15 bp, Homo sapiens
gctctgcattcaggc

SEQ ID NO: 56496 - DNA, 15 bp, Homo sapiens
ctctgcattcaggct

SEQ ID NO: 56497 - DNA, 15 bp, Homo sapiens
tctgcattcaggctg

SEQ ID NO: 56498 - DNA, 15 bp, Homo sapiens
ctgcattcaggctgg

SEQ ID NO: 56499 - DNA, 15 bp, Homo sapiens
tgcattcaggctggt

SEQ ID NO: 56500 - DNA, 15 bp, Homo sapiens
gcattcaggctggtc

SEQ ID NO: 56501 - DNA, 15 bp, Homo sapiens
cattcaggctggtct

SEQ ID NO: 56502 - DNA, 15 bp, Homo sapiens
attcaggctggtctg

SEQ ID NO: 56503 - DNA, 15 bp, Homo sapiens
ttcaggctggtctgt

SEQ ID NO: 56504 - DNA, 15 bp, Homo sapiens
tcaggctggtctgtg

SEQ ID NO: 56505 - DNA, 15 bp, Homo sapiens
caggctggtctgtgc

SEQ ID NO: 56506 - DNA, 15 bp, Homo sapiens
aggctggtctgtgct

SEQ ID NO: 56507 - DNA, 15 bp, Homo sapiens
ggctggtctgtgcta

SEQ ID NO: 56508 - DNA, 15 bp, Homo sapiens
gctggtctgtgctag

SEQ ID NO: 56509 - DNA, 15 bp, Homo sapiens
ctggtctgtgctagg

SEQ ID NO: 56510 - DNA, 15 bp, Homo sapiens
tggtctgtgctaggc

SEQ ID NO: 56511 - DNA, 15 bp, Homo sapiens
ggtctgtgctaggct

SEQ ID NO: 56512 - DNA, 15 bp, Homo sapiens
gtctgtgctaggctt

SEQ ID NO: 56513 - DNA, 15 bp, Homo sapiens
tctgtgctaggcttg

SEQ ID NO: 56514 - DNA, 15 bp, Homo sapiens
ctgtgctaggcttgg

SEQ ID NO: 56515 - DNA, 15 bp, Homo sapiens
tgtgctaggcttggt

SEQ ID NO: 56516 - DNA, 15 bp, Homo sapiens
gtgctaggcttggta

SEQ ID NO: 56517 - DNA, 15 bp, Homo sapiens
tgctaggcttggtat

SEQ ID NO: 56518 - DNA, 15 bp, Homo sapiens
gctaggcttggtatg

SEQ ID NO: 56519 - DNA, 15 bp, Homo sapiens
ctaggcttggtatgg

SEQ ID NO: 56520 - DNA, 15 bp, Homo sapiens
taggcttggtatggg

SEQ ID NO: 56521 - DNA, 15 bp, Homo sapiens
aggcttggtatgggg

SEQ ID NO: 56522 - DNA, 15 bp, Homo sapiens
ggcttggtatggggt

SEQ ID NO: 56523 - DNA, 15 bp, Homo sapiens
gcttggtatggggtt

SEQ ID NO: 56524 - DNA, 15 bp, Homo sapiens
cttggtatggggttg

SEQ ID NO: 56525 - DNA, 15 bp, Homo sapiens
ttggtatggggttgg

SEQ ID NO: 56526 - DNA, 15 bp, Homo sapiens
tggtatggggttgga

SEQ ID NO: 56527 - DNA, 15 bp, Homo sapiens
ggtatggggttggag

SEQ ID NO: 56528 - DNA, 15 bp, Homo sapiens
gtatggggttggagc

SEQ ID NO: 56529 - DNA, 15 bp, Homo sapiens
tatggggttggagcc

SEQ ID NO: 56530 - DNA, 15 bp, Homo sapiens
atggggttggagcct

SEQ ID NO: 56531 - DNA, 15 bp, Homo sapiens
tggggttggagcctg

SEQ ID NO: 56532 - DNA, 15 bp, Homo sapiens
ggggttggagcctgg

SEQ ID NO: 56533 - DNA, 15 bp, Homo sapiens
gggttggagcctgga

SEQ ID NO: 56534 - DNA, 15 bp, Homo sapiens
ggttggagcctggac

SEQ ID NO: 56535 - DNA, 15 bp, Homo sapiens
gttggagcctggact

SEQ ID NO: 56536 - DNA, 15 bp, Homo sapiens
ttggagcctggactt

SEQ ID NO: 56537 - DNA, 15 bp, Homo sapiens
tggagcctggacttg

SEQ ID NO: 56538 - DNA, 15 bp, Homo sapiens
ggagcctggacttgg

SEQ ID NO: 56539 - DNA, 15 bp, Homo sapiens
gagcctggacttggg

SEQ ID NO: 56540 - DNA, 15 bp, Homo sapiens
agcctggacttggga

SEQ ID NO: 56541 - DNA, 15 bp, Homo sapiens
gcctggacttgggaa

SEQ ID NO: 56542 - DNA, 15 bp, Homo sapiens
cctggacttgggaaa

SEQ ID NO: 56543 - DNA, 15 bp, Homo sapiens
ctggacttgggaaat

SEQ ID NO: 56544 - DNA, 15 bp, Homo sapiens
tggacttgggaaata

SEQ ID NO: 56545 - DNA, 15 bp, Homo sapiens
ggacttgggaaatat

SEQ ID NO: 56546 - DNA, 15 bp, Homo sapiens
gacttgggaaatata

SEQ ID NO: 56547 - DNA, 15 bp, Homo sapiens
acttgggaaatatac

SEQ ID NO: 56548 - DNA, 15 bp, Homo sapiens
cttgggaaatatact

SEQ ID NO: 56549 - DNA, 15 bp, Homo sapiens
ttgggaaatatactg

SEQ ID NO: 56550 - DNA, 15 bp, Homo sapiens
tgggaaatatactgg

SEQ ID NO: 56551 - DNA, 15 bp, Homo sapiens
gggaaatatactggg

SEQ ID NO: 56552 - DNA, 15 bp, Homo sapiens
ggaaatatactgggc

SEQ ID NO: 56553 - DNA, 15 bp, Homo sapiens
gaaatatactgggct

SEQ ID NO: 56554 - DNA, 15 bp, Homo sapiens
aaatatactgggctg

SEQ ID NO: 56555 - DNA, 15 bp, Homo sapiens
aatatactgggctga

SEQ ID NO: 56556 - DNA, 15 bp, Homo sapiens
atatactgggctgat

SEQ ID NO: 56557 - DNA, 15 bp, Homo sapiens
tatactgggctgata

SEQ ID NO: 56558 - DNA, 15 bp, Homo sapiens
atactgggctgatag

SEQ ID NO: 56559 - DNA, 15 bp, Homo sapiens
tactgggctgatagg

SEQ ID NO: 56560 - DNA, 15 bp, Homo sapiens
actgggctgatagga

SEQ ID NO: 56561 - DNA, 15 bp, Homo sapiens
ctgggctgataggaa

SEQ ID NO: 56562 - DNA, 15 bp, Homo sapiens
tgggctgataggaat

SEQ ID NO: 56563 - DNA, 15 bp, Homo sapiens
gggctgataggaatt

SEQ ID NO: 56564 - DNA, 15 bp, Homo sapiens
ggctgataggaattt

SEQ ID NO: 56565 - DNA, 15 bp, Homo sapiens
gctgataggaatttg

SEQ ID NO: 56566 - DNA, 15 bp, Homo sapiens
ctgataggaatttga

SEQ ID NO: 56567 - DNA, 15 bp, Homo sapiens
tgataggaatttgat

SEQ ID NO: 56568 - DNA, 15 bp, Homo sapiens
gataggaatttgatt

SEQ ID NO: 56569 - DNA, 15 bp, Homo sapiens
ataggaatttgattg

SEQ ID NO: 56570 - DNA, 15 bp, Homo sapiens
taggaatttgattgg

SEQ ID NO: 56571 - DNA, 15 bp, Homo sapiens
aggaatttgattgga

SEQ ID NO: 56572 - DNA, 15 bp, Homo sapiens
ggaatttgattggat

SEQ ID NO: 56573 - DNA, 15 bp, Homo sapiens
gaatttgattggatt

SEQ ID NO: 56574 - DNA, 15 bp, Homo sapiens
aatttgattggattt

SEQ ID NO: 56575 - DNA, 15 bp, Homo sapiens
atttgattggatttt

SEQ ID NO: 56576 - DNA, 15 bp, Homo sapiens
tttgattggattttc

SEQ ID NO: 56577 - DNA, 15 bp, Homo sapiens
ttgattggattttct

SEQ ID NO: 56578 - DNA, 15 bp, Homo sapiens
tgattggattttctt

SEQ ID NO: 56579 - DNA, 15 bp, Homo sapiens
gattggattttcttg

SEQ ID NO: 56580 - DNA, 15 bp, Homo sapiens
attggattttcttgc

SEQ ID NO: 56581 - DNA, 15 bp, Homo sapiens
ttggattttcttgca

SEQ ID NO: 56582 - DNA, 15 bp, Homo sapiens
tggattttcttgcag

SEQ ID NO: 56583 - DNA, 15 bp, Homo sapiens
ggattttcttgcaga

SEQ ID NO: 56584 - DNA, 15 bp, Homo sapiens
gattttcttgcagag

SEQ ID NO: 56585 - DNA, 15 bp, Homo sapiens
attttcttgcagagt

SEQ ID NO: 56586 - DNA, 15 bp, Homo sapiens
ttttcttgcagagtc

SEQ ID NO: 56587 - DNA, 15 bp, Homo sapiens
tttcttgcagagtca

SEQ ID NO: 56588 - DNA, 15 bp, Homo sapiens
ttcttgcagagtcat

SEQ ID NO: 56589 - DNA, 15 bp, Homo sapiens
tcttgcagagtcatt

SEQ ID NO: 56590 - DNA, 15 bp, Homo sapiens
cttgcagagtcattt

SEQ ID NO: 56591 - DNA, 15 bp, Homo sapiens
ttgcagagtcatttc

SEQ ID NO: 56592 - DNA, 15 bp, Homo sapiens
tgcagagtcatttcc

SEQ ID NO: 56593 - DNA, 15 bp, Homo sapiens
gcagagtcatttcct

SEQ ID NO: 56594 - DNA, 15 bp, Homo sapiens
cagagtcatttccta

SEQ ID NO: 56595 - DNA, 15 bp, Homo sapiens
agagtcatttcctac

SEQ ID NO: 56596 - DNA, 15 bp, Homo sapiens
gagtcatttcctaca

SEQ ID NO: 56597 - DNA, 15 bp, Homo sapiens
agtcatttcctacag

SEQ ID NO: 56598 - DNA, 15 bp, Homo sapiens
gtcatttcctacagt

SEQ ID NO: 56599 - DNA, 15 bp, Homo sapiens
tcatttcctacagtg

SEQ ID NO: 56600 - DNA, 15 bp, Homo sapiens
catttcctacagtgt

SEQ ID NO: 56601 - DNA, 15 bp, Homo sapiens
atttcctacagtgta

SEQ ID NO: 56602 - DNA, 15 bp, Homo sapiens
tttcctacagtgtaa

SEQ ID NO: 56603 - DNA, 15 bp, Homo sapiens
ttcctacagtgtaaa

SEQ ID NO: 56604 - DNA, 15 bp, Homo sapiens
tcctacagtgtaaag

SEQ ID NO: 56605 - DNA, 15 bp, Homo sapiens
cctacagtgtaaaga

SEQ ID NO: 56606 - DNA, 15 bp, Homo sapiens
ctacagtgtaaagag

SEQ ID NO: 56607 - DNA, 15 bp, Homo sapiens
tacagtgtaaagagg

SEQ ID NO: 56608 - DNA, 15 bp, Homo sapiens
acagtgtaaagagga

SEQ ID NO: 56609 - DNA, 15 bp, Homo sapiens
cagtgtaaagaggac

SEQ ID NO: 56610 - DNA, 15 bp, Homo sapiens
agtgtaaagaggaca

SEQ ID NO: 56611 - DNA, 15 bp, Homo sapiens
gtgtaaagaggacaa

SEQ ID NO: 56612 - DNA, 15 bp, Homo sapiens
tgtaaagaggacaac

SEQ ID NO: 56613 - DNA, 15 bp, Homo sapiens
gtaaagaggacaacc

SEQ ID NO: 56614 - DNA, 15 bp, Homo sapiens
taaagaggacaaccc

SEQ ID NO: 56615 - DNA, 15 bp, Homo sapiens
aaagaggacaacccg

SEQ ID NO: 56616 - DNA, 15 bp, Homo sapiens
aagaggacaacccgg

SEQ ID NO: 56617 - DNA, 15 bp, Homo sapiens
agaggacaacccgga

SEQ ID NO: 56618 - DNA, 15 bp, Homo sapiens
gaggacaacccggac

SEQ ID NO: 56619 - DNA, 15 bp, Homo sapiens
aggacaacccggact

SEQ ID NO: 56620 - DNA, 15 bp, Homo sapiens
ggacaacccggactt

SEQ ID NO: 56621 - DNA, 15 bp, Homo sapiens
gacaacccggacttt

SEQ ID NO: 56622 - DNA, 15 bp, Homo sapiens
acaacccggactttg

SEQ ID NO: 56623 - DNA, 15 bp, Homo sapiens
caacccggactttga

SEQ ID NO: 56624 - DNA, 15 bp, Homo sapiens
aacccggactttgaa

SEQ ID NO: 56625 - DNA, 15 bp, Homo sapiens
acccggactttgaag

SEQ ID NO: 56626 - DNA, 15 bp, Homo sapiens
cccggactttgaagg

SEQ ID NO: 56627 - DNA, 15 bp, Homo sapiens
ccggactttgaaggc

SEQ ID NO: 56628 - DNA, 15 bp, Homo sapiens
cggactttgaaggcg

SEQ ID NO: 56629 - DNA, 15 bp, Homo sapiens
ggactttgaaggcgt

SEQ ID NO: 56630 - DNA, 15 bp, Homo sapiens
gactttgaaggcgtg

SEQ ID NO: 56631 - DNA, 15 bp, Homo sapiens
actttgaaggcgtgg

SEQ ID NO: 56632 - DNA, 15 bp, Homo sapiens
ctttgaaggcgtgga

SEQ ID NO: 56633 - DNA, 15 bp, Homo sapiens
tttgaaggcgtggat

SEQ ID NO: 56634 - DNA, 15 bp, Homo sapiens
ttgaaggcgtggatt

SEQ ID NO: 56635 - DNA, 15 bp, Homo sapiens
tgaaggcgtggattg

SEQ ID NO: 56636 - DNA, 15 bp, Homo sapiens
gaaggcgtggattgt

SEQ ID NO: 56637 - DNA, 15 bp, Homo sapiens
aaggcgtggattgtg

SEQ ID NO: 56638 - DNA, 15 bp, Homo sapiens
aggcgtggattgtgc

SEQ ID NO: 56639 - DNA, 15 bp, Homo sapiens
ggcgtggattgtgca

SEQ ID NO: 56640 - DNA, 15 bp, Homo sapiens
gcgtggattgtgcaa

SEQ ID NO: 56641 - DNA, 15 bp, Homo sapiens
cgtggattgtgcaat

SEQ ID NO: 56642 - DNA, 15 bp, Homo sapiens
gtggattgtgcaatc

SEQ ID NO: 56643 - DNA, 15 bp, Homo sapiens
tggattgtgcaatct

SEQ ID NO: 56644 - DNA, 15 bp, Homo sapiens
ggattgtgcaatctt

SEQ ID NO: 56645 - DNA, 15 bp, Homo sapiens
gattgtgcaatcttt

SEQ ID NO: 56646 - DNA, 15 bp, Homo sapiens
attgtgcaatctttg

SEQ ID NO: 56647 - DNA, 15 bp, Homo sapiens
ttgtgcaatctttga

SEQ ID NO: 56648 - DNA, 15 bp, Homo sapiens
tgtgcaatctttgaa

SEQ ID NO: 56649 - DNA, 15 bp, Homo sapiens
gtgcaatctttgaat

SEQ ID NO: 56650 - DNA, 15 bp, Homo sapiens
tgcaatctttgaatc

SEQ ID NO: 56651 - DNA, 15 bp, Homo sapiens
gcaatctttgaatcc

SEQ ID NO: 56652 - DNA, 15 bp, Homo sapiens
caatctttgaatccc

SEQ ID NO: 56653 - DNA, 15 bp, Homo sapiens
aatctttgaatcccc

SEQ ID NO: 56654 - DNA, 15 bp, Homo sapiens
atctttgaatcccca

SEQ ID NO: 56655 - DNA, 15 bp, Homo sapiens
tctttgaatccccat

SEQ ID NO: 56656 - DNA, 15 bp, Homo sapiens
ctttgaatccccata

SEQ ID NO: 56657 - DNA, 15 bp, Homo sapiens
tttgaatccccatac

SEQ ID NO: 56658 - DNA, 15 bp, Homo sapiens
ttgaatccccatacc

SEQ ID NO: 56659 - DNA, 15 bp, Homo sapiens
tgaatccccataccc

SEQ ID NO: 56660 - DNA, 15 bp, Homo sapiens
gaatccccatacccg

SEQ ID NO: 56661 - DNA, 15 bp, Homo sapiens
aatccccatacccga

SEQ ID NO: 56662 - DNA, 15 bp, Homo sapiens
atccccatacccgat

SEQ ID NO: 56663 - DNA, 15 bp, Homo sapiens
tccccatacccgatg

SEQ ID NO: 56664 - DNA, 15 bp, Homo sapiens
ccccatacccgatga

SEQ ID NO: 56665 - DNA, 15 bp, Homo sapiens
cccatacccgatgac

SEQ ID NO: 56666 - DNA, 15 bp, Homo sapiens
ccatacccgatgaca

SEQ ID NO: 56667 - DNA, 15 bp, Homo sapiens
catacccgatgacaa

SEQ ID NO: 56668 - DNA, 15 bp, Homo sapiens
atacccgatgacaat

SEQ ID NO: 56669 - DNA, 15 bp, Homo sapiens
tacccgatgacaatg

SEQ ID NO: 56670 - DNA, 15 bp, Homo sapiens
acccgatgacaatgg

SEQ ID NO: 56671 - DNA, 15 bp, Homo sapiens
cccgatgacaatggc

SEQ ID NO: 56672 - DNA, 15 bp, Homo sapiens
ccgatgacaatggcg

SEQ ID NO: 56673 - DNA, 15 bp, Homo sapiens
cgatgacaatggcgc

SEQ ID NO: 56674 - DNA, 15 bp, Homo sapiens
gatgacaatggcgct

SEQ ID NO: 56675 - DNA, 15 bp, Homo sapiens
atgacaatggcgctc

SEQ ID NO: 56676 - DNA, 15 bp, Homo sapiens
tgacaatggcgctct

SEQ ID NO: 56677 - DNA, 15 bp, Homo sapiens
gacaatggcgctctc

SEQ ID NO: 56678 - DNA, 15 bp, Homo sapiens
acaatggcgctctct

SEQ ID NO: 56679 - DNA, 15 bp, Homo sapiens
caatggcgctctctg

SEQ ID NO: 56680 - DNA, 15 bp, Homo sapiens
aatggcgctctctgt

SEQ ID NO: 56681 - DNA, 15 bp, Homo sapiens
atggcgctctctgtt

SEQ ID NO: 56682 - DNA, 15 bp, Homo sapiens
tggcgctctctgttc

SEQ ID NO: 56683 - DNA, 15 bp, Homo sapiens
ggcgctctctgttct

SEQ ID NO: 56684 - DNA, 15 bp, Homo sapiens
gcgctctctgttcta

SEQ ID NO: 56685 - DNA, 15 bp, Homo sapiens
cgctctctgttctag

SEQ ID NO: 56686 - DNA, 15 bp, Homo sapiens
gctctctgttctagt

SEQ ID NO: 56687 - DNA, 15 bp, Homo sapiens
ctctctgttctagta

SEQ ID NO: 56688 - DNA, 15 bp, Homo sapiens
tctctgttctagtaa

SEQ ID NO: 56689 - DNA, 15 bp, Homo sapiens
ctctgttctagtaac

SEQ ID NO: 56690 - DNA, 15 bp, Homo sapiens
tctgttctagtaact

SEQ ID NO: 56691 - DNA, 15 bp, Homo sapiens
ctgttctagtaacta

SEQ ID NO: 56692 - DNA, 15 bp, Homo sapiens
tgttctagtaactat

SEQ ID NO: 56693 - DNA, 15 bp, Homo sapiens
gttctagtaactata

SEQ ID NO: 56694 - DNA, 15 bp, Homo sapiens
ttctagtaactatag

SEQ ID NO: 56695 - DNA, 15 bp, Homo sapiens
tctagtaactataga

SEQ ID NO: 56696 - DNA, 15 bp, Homo sapiens
ctagtaactatagaa

SEQ ID NO: 56697 - DNA, 15 bp, Homo sapiens
tagtaactatagaaa

SEQ ID NO: 56698 - DNA, 15 bp, Homo sapiens
agtaactatagaaat

SEQ ID NO: 56699 - DNA, 15 bp, Homo sapiens
gtaactatagaaatg

SEQ ID NO: 56700 - DNA, 15 bp, Homo sapiens
taactatagaaatgt

SEQ ID NO: 56701 - DNA, 15 bp, Homo sapiens
aactatagaaatgtg

SEQ ID NO: 56702 - DNA, 15 bp, Homo sapiens
actatagaaatgtgt

SEQ ID NO: 56703 - DNA, 15 bp, Homo sapiens
ctatagaaatgtgta

SEQ ID NO: 56704 - DNA, 15 bp, Homo sapiens
tatagaaatgtgtaa

SEQ ID NO: 56705 - DNA, 15 bp, Homo sapiens
atagaaatgtgtaac

SEQ ID NO: 56706 - DNA, 15 bp, Homo sapiens
tagaaatgtgtaacg

SEQ ID NO: 56707 - DNA, 15 bp, Homo sapiens
agaaatgtgtaacgc

SEQ ID NO: 56708 - DNA, 15 bp, Homo sapiens
gaaatgtgtaacgcc

SEQ ID NO: 56709 - DNA, 15 bp, Homo sapiens
aaatgtgtaacgccc

SEQ ID NO: 56710 - DNA, 15 bp, Homo sapiens
aatgtgtaacgccct

SEQ ID NO: 56711 - DNA, 15 bp, Homo sapiens
atgtgtaacgccctc

SEQ ID NO: 56712 - DNA, 15 bp, Homo sapiens
tgtgtaacgccctca

SEQ ID NO: 56713 - DNA, 15 bp, Homo sapiens
gtgtaacgccctcaa

SEQ ID NO: 56714 - DNA, 15 bp, Homo sapiens
tgtaacgccctcaac

SEQ ID NO: 56715 - DNA, 15 bp, Homo sapiens
gtaacgccctcaaca

SEQ ID NO: 56716 - DNA, 15 bp, Homo sapiens
taacgccctcaacag

SEQ ID NO: 56717 - DNA, 15 bp, Homo sapiens
aacgccctcaacagg

SEQ ID NO: 56718 - DNA, 15 bp, Homo sapiens
acgccctcaacaggt

SEQ ID NO: 56719 - DNA, 15 bp, Homo sapiens
cgccctcaacaggtt

SEQ ID NO: 56720 - DNA, 15 bp, Homo sapiens
gccctcaacaggtta

SEQ ID NO: 56721 - DNA, 15 bp, Homo sapiens
ccctcaacaggttag

SEQ ID NO: 56722 - DNA, 15 bp, Homo sapiens
cctcaacaggttagt

SEQ ID NO: 56723 - DNA, 15 bp, Homo sapiens
ctcaacaggttagtg

SEQ ID NO: 56724 - DNA, 15 bp, Homo sapiens
tcaacaggttagtgc

SEQ ID NO: 56725 - DNA, 15 bp, Homo sapiens
caacaggttagtgca

SEQ ID NO: 56726 - DNA, 15 bp, Homo sapiens
aacaggttagtgcac

SEQ ID NO: 56727 - DNA, 15 bp, Homo sapiens
acaggttagtgcacc

SEQ ID NO: 56728 - DNA, 15 bp, Homo sapiens
caggttagtgcacct

SEQ ID NO: 56729 - DNA, 15 bp, Homo sapiens
aggttagtgcacctt

SEQ ID NO: 56730 - DNA, 15 bp, Homo sapiens
ggttagtgcaccttc

SEQ ID NO: 56731 - DNA, 15 bp, Homo sapiens
gttagtgcaccttca

SEQ ID NO: 56732 - DNA, 15 bp, Homo sapiens
ttagtgcaccttcac

SEQ ID NO: 56733 - DNA, 15 bp, Homo sapiens
tagtgcaccttcacg

SEQ ID NO: 56734 - DNA, 15 bp, Homo sapiens
agtgcaccttcacgg

SEQ ID NO: 56735 - DNA, 15 bp, Homo sapiens
gtgcaccttcacggc

SEQ ID NO: 56736 - DNA, 15 bp, Homo sapiens
tgcaccttcacggca

SEQ ID NO: 56737 - DNA, 15 bp, Homo sapiens
gcaccttcacggcag

SEQ ID NO: 56738 - DNA, 15 bp, Homo sapiens
caccttcacggcagg

SEQ ID NO: 56739 - DNA, 15 bp, Homo sapiens
accttcacggcaggc

SEQ ID NO: 56740 - DNA, 15 bp, Homo sapiens
ccttcacggcaggct

SEQ ID NO: 56741 - DNA, 15 bp, Homo sapiens
cttcacggcaggctg

SEQ ID NO: 56742 - DNA, 15 bp, Homo sapiens
ttcacggcaggctga

SEQ ID NO: 56743 - DNA, 15 bp, Homo sapiens
tcacggcaggctgag

SEQ ID NO: 56744 - DNA, 15 bp, Homo sapiens
cacggcaggctgagg

SEQ ID NO: 56745 - DNA, 15 bp, Homo sapiens
acggcaggctgaggc

SEQ ID NO: 56746 - DNA, 15 bp, Homo sapiens
cggcaggctgaggcg

SEQ ID NO: 56747 - DNA, 15 bp, Homo sapiens
ggcaggctgaggcga

SEQ ID NO: 56748 - DNA, 15 bp, Homo sapiens
gcaggctgaggcgag

SEQ ID NO: 56749 - DNA, 15 bp, Homo sapiens
caggctgaggcgagc

SEQ ID NO: 56750 - DNA, 15 bp, Homo sapiens
aggctgaggcgagca

SEQ ID NO: 56751 - DNA, 15 bp, Homo sapiens
ggctgaggcgagcat

SEQ ID NO: 56752 - DNA, 15 bp, Homo sapiens
gctgaggcgagcatg

SEQ ID NO: 56753 - DNA, 15 bp, Homo sapiens
ctgaggcgagcatgg

SEQ ID NO: 56754 - DNA, 15 bp, Homo sapiens
tgaggcgagcatggt

SEQ ID NO: 56755 - DNA, 15 bp, Homo sapiens
gaggcgagcatggtg

SEQ ID NO: 56756 - DNA, 15 bp, Homo sapiens
aggcgagcatggtga

SEQ ID NO: 56757 - DNA, 15 bp, Homo sapiens
ggcgagcatggtgac

SEQ ID NO: 56758 - DNA, 15 bp, Homo sapiens
gcgagcatggtgact

SEQ ID NO: 56759 - DNA, 15 bp, Homo sapiens
cgagcatggtgactg

SEQ ID NO: 56760 - DNA, 15 bp, Homo sapiens
gagcatggtgactgc

SEQ ID NO: 56761 - DNA, 15 bp, Homo sapiens
agcatggtgactgcc

SEQ ID NO: 56762 - DNA, 15 bp, Homo sapiens
gcatggtgactgcca

SEQ ID NO: 56763 - DNA, 15 bp, Homo sapiens
catggtgactgccag

SEQ ID NO: 56764 - DNA, 15 bp, Homo sapiens
atggtgactgccagg

SEQ ID NO: 56765 - DNA, 15 bp, Homo sapiens
tggtgactgccaggg

SEQ ID NO: 56766 - DNA, 15 bp, Homo sapiens
ggtgactgccagggc

SEQ ID NO: 56767 - DNA, 15 bp, Homo sapiens
gtgactgccagggca

SEQ ID NO: 56768 - DNA, 15 bp, Homo sapiens
tgactgccagggcac

SEQ ID NO: 56769 - DNA, 15 bp, Homo sapiens
gactgccagggcacc

SEQ ID NO: 56770 - DNA, 15 bp, Homo sapiens
actgccagggcaccg

SEQ ID NO: 56771 - DNA, 15 bp, Homo sapiens
ctgccagggcaccgg

SEQ ID NO: 56772 - DNA, 15 bp, Homo sapiens
tgccagggcaccggg

SEQ ID NO: 56773 - DNA, 15 bp, Homo sapiens
gccagggcaccgggg

SEQ ID NO: 56774 - DNA, 15 bp, Homo sapiens
ccagggcaccgggga

SEQ ID NO: 56775 - DNA, 15 bp, Homo sapiens
cagggcaccggggaa

SEQ ID NO: 56776 - DNA, 15 bp, Homo sapiens
agggcaccggggaat

SEQ ID NO: 56777 - DNA, 15 bp, Homo sapiens
gggcaccggggaatt

SEQ ID NO: 56778 - DNA, 15 bp, Homo sapiens
ggcaccggggaattg

SEQ ID NO: 56779 - DNA, 15 bp, Homo sapiens
gcaccggggaattgt

SEQ ID NO: 56780 - DNA, 15 bp, Homo sapiens
caccggggaattgtg

SEQ ID NO: 56781 - DNA, 15 bp, Homo sapiens
accggggaattgtgt

SEQ ID NO: 56782 - DNA, 15 bp, Homo sapiens
ccggggaattgtgtg

SEQ ID NO: 56783 - DNA, 15 bp, Homo sapiens
cggggaattgtgtgt

SEQ ID NO: 56784 - DNA, 15 bp, Homo sapiens
ggggaattgtgtgta

SEQ ID NO: 56785 - DNA, 15 bp, Homo sapiens
gggaattgtgtgtag

SEQ ID NO: 56786 - DNA, 15 bp, Homo sapiens
ggaattgtgtgtagt

SEQ ID NO: 56787 - DNA, 15 bp, Homo sapiens
gaattgtgtgtagtc

SEQ ID NO: 56788 - DNA, 15 bp, Homo sapiens
aattgtgtgtagtca

SEQ ID NO: 56789 - DNA, 15 bp, Homo sapiens
attgtgtgtagtcac

SEQ ID NO: 56790 - DNA, 15 bp, Homo sapiens
ttgtgtgtagtcacg

SEQ ID NO: 56791 - DNA, 15 bp, Homo sapiens
tgtgtgtagtcacgg

SEQ ID NO: 56792 - DNA, 15 bp, Homo sapiens
gtgtgtagtcacggt

SEQ ID NO: 56793 - DNA, 15 bp, Homo sapiens
tgtgtagtcacggtt

SEQ ID NO: 56794 - DNA, 15 bp, Homo sapiens
gtgtagtcacggttg

SEQ ID NO: 56795 - DNA, 15 bp, Homo sapiens
tgtagtcacggttga

SEQ ID NO: 56796 - DNA, 15 bp, Homo sapiens
gtagtcacggttgat

SEQ ID NO: 56797 - DNA, 15 bp, Homo sapiens
tagtcacggttgatt

SEQ ID NO: 56798 - DNA, 15 bp, Homo sapiens
agtcacggttgattg

SEQ ID NO: 56799 - DNA, 15 bp, Homo sapiens
gtcacggttgattga

SEQ ID NO: 56800 - DNA, 15 bp, Homo sapiens
tcacggttgattgag

SEQ ID NO: 56801 - DNA, 15 bp, Homo sapiens
cacggttgattgagg

SEQ ID NO: 56802 - DNA, 15 bp, Homo sapiens
acggttgattgagga

SEQ ID NO: 56803 - DNA, 15 bp, Homo sapiens
cggttgattgaggat

SEQ ID NO: 56804 - DNA, 15 bp, Homo sapiens
ggttgattgaggatc

SEQ ID NO: 56805 - DNA, 15 bp, Homo sapiens
gttgattgaggatca

SEQ ID NO: 56806 - DNA, 15 bp, Homo sapiens
ttgattgaggatcac

SEQ ID NO: 56807 - DNA, 15 bp, Homo sapiens
tgattgaggatcaca

SEQ ID NO: 56808 - DNA, 15 bp, Homo sapiens
gattgaggatcacag

SEQ ID NO: 56809 - DNA, 15 bp, Homo sapiens
attgaggatcacagg

SEQ ID NO: 56810 - DNA, 15 bp, Homo sapiens
ttgaggatcacagga

SEQ ID NO: 56811 - DNA, 15 bp, Homo sapiens
tgaggatcacaggac

SEQ ID NO: 56812 - DNA, 15 bp, Homo sapiens
gaggatcacaggaca

SEQ ID NO: 56813 - DNA, 15 bp, Homo sapiens
aggatcacaggacag

SEQ ID NO: 56814 - DNA, 15 bp, Homo sapiens
ggatcacaggacagt

SEQ ID NO: 56815 - DNA, 15 bp, Homo sapiens
gatcacaggacagtt

SEQ ID NO: 56816 - DNA, 15 bp, Homo sapiens
atcacaggacagttc

SEQ ID NO: 56817 - DNA, 15 bp, Homo sapiens
tcacaggacagttct

SEQ ID NO: 56818 - DNA, 15 bp, Homo sapiens
cacaggacagttctt

SEQ ID NO: 56819 - DNA, 15 bp, Homo sapiens
acaggacagttcttc

SEQ ID NO: 56820 - DNA, 15 bp, Homo sapiens
caggacagttcttcc

SEQ ID NO: 56821 - DNA, 15 bp, Homo sapiens
aggacagttcttccc

SEQ ID NO: 56822 - DNA, 15 bp, Homo sapiens
ggacagttcttccct

SEQ ID NO: 56823 - DNA, 15 bp, Homo sapiens
gacagttcttccctt

SEQ ID NO: 56824 - DNA, 15 bp, Homo sapiens
acagttcttcccttc

SEQ ID NO: 56825 - DNA, 15 bp, Homo sapiens
cagttcttcccttcc

SEQ ID NO: 56826 - DNA, 15 bp, Homo sapiens
agttcttcccttccc

SEQ ID NO: 56827 - DNA, 15 bp, Homo sapiens
gttcttcccttccca

SEQ ID NO: 56828 - DNA, 15 bp, Homo sapiens
ttcttcccttcccaa

SEQ ID NO: 56829 - DNA, 15 bp, Homo sapiens
tcttcccttcccaaa

SEQ ID NO: 56830 - DNA, 15 bp, Homo sapiens
cttcccttcccaaaa

SEQ ID NO: 56831 - DNA, 15 bp, Homo sapiens
ttcccttcccaaaag

SEQ ID NO: 56832 - DNA, 15 bp, Homo sapiens
tcccttcccaaaaga

SEQ ID NO: 56833 - DNA, 15 bp, Homo sapiens
cccttcccaaaagaa

SEQ ID NO: 56834 - DNA, 15 bp, Homo sapiens
ccttcccaaaagaaa

SEQ ID NO: 56835 - DNA, 15 bp, Homo sapiens
cttcccaaaagaaag

SEQ ID NO: 56836 - DNA, 15 bp, Homo sapiens
ttcccaaaagaaagg

SEQ ID NO: 56837 - DNA, 15 bp, Homo sapiens
tcccaaaagaaagga

SEQ ID NO: 56838 - DNA, 15 bp, Homo sapiens
cccaaaagaaaggag

SEQ ID NO: 56839 - DNA, 15 bp, Homo sapiens
ccaaaagaaaggaga

SEQ ID NO: 56840 - DNA, 15 bp, Homo sapiens
caaaagaaaggagaa

SEQ ID NO: 56841 - DNA, 15 bp, Homo sapiens
aaaagaaaggagaac

SEQ ID NO: 56842 - DNA, 15 bp, Homo sapiens
aaagaaaggagaaca

SEQ ID NO: 56843 - DNA, 15 bp, Homo sapiens
aagaaaggagaacag

SEQ ID NO: 56844 - DNA, 15 bp, Homo sapiens
agaaaggagaacagg

SEQ ID NO: 56845 - DNA, 15 bp, Homo sapiens
gaaaggagaacaggc

SEQ ID NO: 56846 - DNA, 15 bp, Homo sapiens
aaaggagaacaggca

SEQ ID NO: 56847 - DNA, 15 bp, Homo sapiens
aaggagaacaggcaa

SEQ ID NO: 56848 - DNA, 15 bp, Homo sapiens
aggagaacaggcaat

SEQ ID NO: 56849 - DNA, 15 bp, Homo sapiens
ggagaacaggcaata

SEQ ID NO: 56850 - DNA, 15 bp, Homo sapiens
gagaacaggcaatac

SEQ ID NO: 56851 - DNA, 15 bp, Homo sapiens
agaacaggcaatacc

SEQ ID NO: 56852 - DNA, 15 bp, Homo sapiens
gaacaggcaatacca

SEQ ID NO: 56853 - DNA, 15 bp, Homo sapiens
aacaggcaataccag

SEQ ID NO: 56854 - DNA, 15 bp, Homo sapiens
acaggcaataccagt

SEQ ID NO: 56855 - DNA, 15 bp, Homo sapiens
caggcaataccagtt

SEQ ID NO: 56856 - DNA, 15 bp, Homo sapiens
aggcaataccagttt

SEQ ID NO: 56857 - DNA, 15 bp, Homo sapiens
ggcaataccagtttt

SEQ ID NO: 56858 - DNA, 15 bp, Homo sapiens
gcaataccagtttta

SEQ ID NO: 56859 - DNA, 15 bp, Homo sapiens
caataccagttttaa

SEQ ID NO: 56860 - DNA, 15 bp, Homo sapiens
aataccagttttaaa

SEQ ID NO: 56861 - DNA, 15 bp, Homo sapiens
ataccagttttaaaa

SEQ ID NO: 56862 - DNA, 15 bp, Homo sapiens
taccagttttaaaag

SEQ ID NO: 56863 - DNA, 15 bp, Homo sapiens
accagttttaaaagc

SEQ ID NO: 56864 - DNA, 15 bp, Homo sapiens
ccagttttaaaagca

SEQ ID NO: 56865 - DNA, 15 bp, Homo sapiens
cagttttaaaagcat

SEQ ID NO: 56866 - DNA, 15 bp, Homo sapiens
agttttaaaagcatg

SEQ ID NO: 56867 - DNA, 15 bp, Homo sapiens
gttttaaaagcatga

SEQ ID NO: 56868 - DNA, 15 bp, Homo sapiens
ttttaaaagcatgag

SEQ ID NO: 56869 - DNA, 15 bp, Homo sapiens
tttaaaagcatgagc

SEQ ID NO: 56870 - DNA, 15 bp, Homo sapiens
ttaaaagcatgagct

SEQ ID NO: 56871 - DNA, 15 bp, Homo sapiens
taaaagcatgagctg

SEQ ID NO: 56872 - DNA, 15 bp, Homo sapiens
aaaagcatgagctgt

SEQ ID NO: 56873 - DNA, 15 bp, Homo sapiens
aaagcatgagctgtc

SEQ ID NO: 56874 - DNA, 15 bp, Homo sapiens
aagcatgagctgtcg

SEQ ID NO: 56875 - DNA, 15 bp, Homo sapiens
agcatgagctgtcgt

SEQ ID NO: 56876 - DNA, 15 bp, Homo sapiens
gcatgagctgtcgtc

SEQ ID NO: 56877 - DNA, 15 bp, Homo sapiens
catgagctgtcgtca

SEQ ID NO: 56878 - DNA, 15 bp, Homo sapiens
atgagctgtcgtcac

SEQ ID NO: 56879 - DNA, 15 bp, Homo sapiens
tgagctgtcgtcacc

SEQ ID NO: 56880 - DNA, 15 bp, Homo sapiens
gagctgtcgtcacct

SEQ ID NO: 56881 - DNA, 15 bp, Homo sapiens
agctgtcgtcacctc

SEQ ID NO: 56882 - DNA, 15 bp, Homo sapiens
gctgtcgtcacctcc

SEQ ID NO: 56883 - DNA, 15 bp, Homo sapiens
ctgtcgtcacctcca

SEQ ID NO: 56884 - DNA, 15 bp, Homo sapiens
tgtcgtcacctccag

SEQ ID NO: 56885 - DNA, 15 bp, Homo sapiens
gtcgtcacctccagg

SEQ ID NO: 56886 - DNA, 15 bp, Homo sapiens
tcgtcacctccagga

SEQ ID NO: 56887 - DNA, 15 bp, Homo sapiens
cgtcacctccaggaa

SEQ ID NO: 56888 - DNA, 15 bp, Homo sapiens
gtcacctccaggaag

SEQ ID NO: 56889 - DNA, 15 bp, Homo sapiens
tcacctccaggaagt

SEQ ID NO: 56890 - DNA, 15 bp, Homo sapiens
cacctccaggaagta

SEQ ID NO: 56891 - DNA, 15 bp, Homo sapiens
acctccaggaagtag

SEQ ID NO: 56892 - DNA, 15 bp, Homo sapiens
cctccaggaagtagt

SEQ ID NO: 56893 - DNA, 15 bp, Homo sapiens
ctccaggaagtagtg

SEQ ID NO: 56894 - DNA, 15 bp, Homo sapiens
tccaggaagtagtgg

SEQ ID NO: 56895 - DNA, 15 bp, Homo sapiens
ccaggaagtagtggg

SEQ ID NO: 56896 - DNA, 15 bp, Homo sapiens
caggaagtagtggga

SEQ ID NO: 56897 - DNA, 15 bp, Homo sapiens
aggaagtagtgggag

SEQ ID NO: 56898 - DNA, 15 bp, Homo sapiens
ggaagtagtgggagt

SEQ ID NO: 56899 - DNA, 15 bp, Homo sapiens
gaagtagtgggagtg

SEQ ID NO: 56900 - DNA, 15 bp, Homo sapiens
aagtagtgggagtgc

SEQ ID NO: 56901 - DNA, 15 bp, Homo sapiens
agtagtgggagtgct

SEQ ID NO: 56902 - DNA, 15 bp, Homo sapiens
gtagtgggagtgctt

SEQ ID NO: 56903 - DNA, 15 bp, Homo sapiens
tagtgggagtgctta

SEQ ID NO: 56904 - DNA, 15 bp, Homo sapiens
agtgggagtgcttag

SEQ ID NO: 56905 - DNA, 15 bp, Homo sapiens
gtgggagtgcttagc

SEQ ID NO: 56906 - DNA, 15 bp, Homo sapiens
tgggagtgcttagcc

SEQ ID NO: 56907 - DNA, 15 bp, Homo sapiens
gggagtgcttagccc

SEQ ID NO: 56908 - DNA, 15 bp, Homo sapiens
ggagtgcttagccct

SEQ ID NO: 56909 - DNA, 15 bp, Homo sapiens
gagtgcttagccctg

SEQ ID NO: 56910 - DNA, 15 bp, Homo sapiens
agtgcttagccctgt

SEQ ID NO: 56911 - DNA, 15 bp, Homo sapiens
gtgcttagccctgtg

SEQ ID NO: 56912 - DNA, 15 bp, Homo sapiens
tgcttagccctgtgt

SEQ ID NO: 56913 - DNA, 15 bp, Homo sapiens
gcttagccctgtgtt

SEQ ID NO: 56914 - DNA, 15 bp, Homo sapiens
cttagccctgtgttt

SEQ ID NO: 56915 - DNA, 15 bp, Homo sapiens
ttagccctgtgtttc

SEQ ID NO: 56916 - DNA, 15 bp, Homo sapiens
tagccctgtgtttct

SEQ ID NO: 56917 - DNA, 15 bp, Homo sapiens
agccctgtgtttctt

SEQ ID NO: 56918 - DNA, 15 bp, Homo sapiens
gccctgtgtttctta

SEQ ID NO: 56919 - DNA, 15 bp, Homo sapiens
ccctgtgtttcttag

SEQ ID NO: 56920 - DNA, 15 bp, Homo sapiens
cctgtgtttcttagg

SEQ ID NO: 56921 - DNA, 15 bp, Homo sapiens
ctgtgtttcttagga

SEQ ID NO: 56922 - DNA, 15 bp, Homo sapiens
tgtgtttcttaggag

SEQ ID NO: 56923 - DNA, 15 bp, Homo sapiens
gtgtttcttaggagc

SEQ ID NO: 56924 - DNA, 15 bp, Homo sapiens
tgtttcttaggagct

SEQ ID NO: 56925 - DNA, 15 bp, Homo sapiens
gtttcttaggagctc

SEQ ID NO: 56926 - DNA, 15 bp, Homo sapiens
tttcttaggagctct

SEQ ID NO: 56927 - DNA, 15 bp, Homo sapiens
ttcttaggagctctt

SEQ ID NO: 56928 - DNA, 15 bp, Homo sapiens
tcttaggagctcttc

SEQ ID NO: 56929 - DNA, 15 bp, Homo sapiens
cttaggagctcttcc

SEQ ID NO: 56930 - DNA, 15 bp, Homo sapiens
ttaggagctcttcct

SEQ ID NO: 56931 - DNA, 15 bp, Homo sapiens
taggagctcttcctt

SEQ ID NO: 56932 - DNA, 15 bp, Homo sapiens
aggagctcttcctta

SEQ ID NO: 56933 - DNA, 15 bp, Homo sapiens
ggagctcttccttaa

SEQ ID NO: 56934 - DNA, 15 bp, Homo sapiens
gagctcttccttaaa

SEQ ID NO: 56935 - DNA, 15 bp, Homo sapiens
agctcttccttaaaa

SEQ ID NO: 56936 - DNA, 15 bp, Homo sapiens
gctcttccttaaaag

SEQ ID NO: 56937 - DNA, 15 bp, Homo sapiens
ctcttccttaaaaga

SEQ ID NO: 56938 - DNA, 15 bp, Homo sapiens
tcttccttaaaagaa

SEQ ID NO: 56939 - DNA, 15 bp, Homo sapiens
cttccttaaaagaaa

SEQ ID NO: 56940 - DNA, 15 bp, Homo sapiens
ttccttaaaagaaac

SEQ ID NO: 56941 - DNA, 15 bp, Homo sapiens
tccttaaaagaaacc

SEQ ID NO: 56942 - DNA, 15 bp, Homo sapiens
ccttaaaagaaaccg

SEQ ID NO: 56943 - DNA, 15 bp, Homo sapiens
cttaaaagaaaccgt

SEQ ID NO: 56944 - DNA, 15 bp, Homo sapiens
ttaaaagaaaccgtg

SEQ ID NO: 56945 - DNA, 15 bp, Homo sapiens
taaaagaaaccgtgg

SEQ ID NO: 56946 - DNA, 15 bp, Homo sapiens
aaaagaaaccgtggg

SEQ ID NO: 56947 - DNA, 15 bp, Homo sapiens
aaagaaaccgtgggg

SEQ ID NO: 56948 - DNA, 15 bp, Homo sapiens
aagaaaccgtggggg

SEQ ID NO: 56949 - DNA, 15 bp, Homo sapiens
agaaaccgtgggggc

SEQ ID NO: 56950 - DNA, 15 bp, Homo sapiens
gaaaccgtgggggcc

SEQ ID NO: 56951 - DNA, 15 bp, Homo sapiens
aaaccgtgggggcca

SEQ ID NO: 56952 - DNA, 15 bp, Homo sapiens
aaccgtgggggccaa

SEQ ID NO: 56953 - DNA, 15 bp, Homo sapiens
accgtgggggccaaa

SEQ ID NO: 56954 - DNA, 15 bp, Homo sapiens
ccgtgggggccaaaa

SEQ ID NO: 56955 - DNA, 15 bp, Homo sapiens
cgtgggggccaaaaa

SEQ ID NO: 56956 - DNA, 15 bp, Homo sapiens
gtgggggccaaaaat

SEQ ID NO: 56957 - DNA, 15 bp, Homo sapiens
tgggggccaaaaata

SEQ ID NO: 56958 - DNA, 15 bp, Homo sapiens
gggggccaaaaatag

SEQ ID NO: 56959 - DNA, 15 bp, Homo sapiens
ggggccaaaaatagg

SEQ ID NO: 56960 - DNA, 15 bp, Homo sapiens
gggccaaaaatagga

SEQ ID NO: 56961 - DNA, 15 bp, Homo sapiens
ggccaaaaataggaa

SEQ ID NO: 56962 - DNA, 15 bp, Homo sapiens
gccaaaaataggaac

SEQ ID NO: 56963 - DNA, 15 bp, Homo sapiens
ccaaaaataggaact

SEQ ID NO: 56964 - DNA, 15 bp, Homo sapiens
caaaaataggaactt

SEQ ID NO: 56965 - DNA, 15 bp, Homo sapiens
aaaaataggaacttt

SEQ ID NO: 56966 - DNA, 15 bp, Homo sapiens
aaaataggaactttg

SEQ ID NO: 56967 - DNA, 15 bp, Homo sapiens
aaataggaactttgg

SEQ ID NO: 56968 - DNA, 15 bp, Homo sapiens
aataggaactttggt

SEQ ID NO: 56969 - DNA, 15 bp, Homo sapiens
ataggaactttggta

SEQ ID NO: 56970 - DNA, 15 bp, Homo sapiens
taggaactttggtac

SEQ ID NO: 56971 - DNA, 15 bp, Homo sapiens
aggaactttggtacc

SEQ ID NO: 56972 - DNA, 15 bp, Homo sapiens
ggaactttggtaccc

SEQ ID NO: 56973 - DNA, 15 bp, Homo sapiens
gaactttggtacccc

SEQ ID NO: 56974 - DNA, 15 bp, Homo sapiens
aactttggtacccct

SEQ ID NO: 56975 - DNA, 15 bp, Homo sapiens
actttggtacccctg

SEQ ID NO: 56976 - DNA, 15 bp, Homo sapiens
ctttggtacccctgt

SEQ ID NO: 56977 - DNA, 15 bp, Homo sapiens
tttggtacccctgta

SEQ ID NO: 56978 - DNA, 15 bp, Homo sapiens
ttggtacccctgtat

SEQ ID NO: 56979 - DNA, 15 bp, Homo sapiens
tggtacccctgtatg

SEQ ID NO: 56980 - DNA, 15 bp, Homo sapiens
ggtacccctgtatgc

SEQ ID NO: 56981 - DNA, 15 bp, Homo sapiens
gtacccctgtatgcc

SEQ ID NO: 56982 - DNA, 15 bp, Homo sapiens
tacccctgtatgcca

SEQ ID NO: 56983 - DNA, 15 bp, Homo sapiens
acccctgtatgccag

SEQ ID NO: 56984 - DNA, 15 bp, Homo sapiens
cccctgtatgccagc

SEQ ID NO: 56985 - DNA, 15 bp, Homo sapiens
ccctgtatgccagca

SEQ ID NO: 56986 - DNA, 15 bp, Homo sapiens
cctgtatgccagcac

SEQ ID NO: 56987 - DNA, 15 bp, Homo sapiens
ctgtatgccagcacc

SEQ ID NO: 56988 - DNA, 15 bp, Homo sapiens
tgtatgccagcaccc

SEQ ID NO: 56989 - DNA, 15 bp, Homo sapiens
gtatgccagcaccca

SEQ ID NO: 56990 - DNA, 15 bp, Homo sapiens
tatgccagcacccac

SEQ ID NO: 56991 - DNA, 15 bp, Homo sapiens
atgccagcacccaca

SEQ ID NO: 56992 - DNA, 15 bp, Homo sapiens
tgccagcacccacag

SEQ ID NO: 56993 - DNA, 15 bp, Homo sapiens
gccagcacccacagg

SEQ ID NO: 56994 - DNA, 15 bp, Homo sapiens
ccagcacccacaggg

SEQ ID NO: 56995 - DNA, 15 bp, Homo sapiens
cagcacccacaggga

SEQ ID NO: 56996 - DNA, 15 bp, Homo sapiens
agcacccacagggaa

SEQ ID NO: 56997 - DNA, 15 bp, Homo sapiens
gcacccacagggaag

SEQ ID NO: 56998 - DNA, 15 bp, Homo sapiens
cacccacagggaagg

SEQ ID NO: 56999 - DNA, 15 bp, Homo sapiens
acccacagggaagga

SEQ ID NO: 57000 - DNA, 15 bp, Homo sapiens
cccacagggaaggaa

SEQ ID NO: 57001 - DNA, 15 bp, Homo sapiens
ccacagggaaggaac

SEQ ID NO: 57002 - DNA, 15 bp, Homo sapiens
cacagggaaggaacc

SEQ ID NO: 57003 - DNA, 15 bp, Homo sapiens
acagggaaggaacct

SEQ ID NO: 57004 - DNA, 15 bp, Homo sapiens
cagggaaggaacctc

SEQ ID NO: 57005 - DNA, 15 bp, Homo sapiens
agggaaggaacctca

SEQ ID NO: 57006 - DNA, 15 bp, Homo sapiens
gggaaggaacctcac

SEQ ID NO: 57007 - DNA, 15 bp, Homo sapiens
ggaaggaacctcacc

SEQ ID NO: 57008 - DNA, 15 bp, Homo sapiens
gaaggaacctcaccc

SEQ ID NO: 57009 - DNA, 15 bp, Homo sapiens
aaggaacctcaccct

SEQ ID NO: 57010 - DNA, 15 bp, Homo sapiens
aggaacctcaccctt

SEQ ID NO: 57011 - DNA, 15 bp, Homo sapiens
ggaacctcacccttt

SEQ ID NO: 57012 - DNA, 15 bp, Homo sapiens
gaacctcaccctttc

SEQ ID NO: 57013 - DNA, 15 bp, Homo sapiens
aacctcaccctttca

SEQ ID NO: 57014 - DNA, 15 bp, Homo sapiens
acctcaccctttcac

SEQ ID NO: 57015 - DNA, 15 bp, Homo sapiens
cctcaccctttcaca

SEQ ID NO: 57016 - DNA, 15 bp, Homo sapiens
ctcaccctttcacac

SEQ ID NO: 57017 - DNA, 15 bp, Homo sapiens
tcaccctttcacaca

SEQ ID NO: 57018 - DNA, 15 bp, Homo sapiens
caccctttcacacag

SEQ ID NO: 57019 - DNA, 15 bp, Homo sapiens
accctttcacacaga

SEQ ID NO: 57020 - DNA, 15 bp, Homo sapiens
ccctttcacacagac

SEQ ID NO: 57021 - DNA, 15 bp, Homo sapiens
cctttcacacagaca

SEQ ID NO: 57022 - DNA, 15 bp, Homo sapiens
ctttcacacagacaa

SEQ ID NO: 57023 - DNA, 15 bp, Homo sapiens
tttcacacagacaaa

SEQ ID NO: 57024 - DNA, 15 bp, Homo sapiens
ttcacacagacaaat

SEQ ID NO: 57025 - DNA, 15 bp, Homo sapiens
tcacacagacaaatg

SEQ ID NO: 57026 - DNA, 15 bp, Homo sapiens
cacacagacaaatgg

SEQ ID NO: 57027 - DNA, 15 bp, Homo sapiens
acacagacaaatggt

SEQ ID NO: 57028 - DNA, 15 bp, Homo sapiens
cacagacaaatggta

SEQ ID NO: 57029 - DNA, 15 bp, Homo sapiens
acagacaaatggtac

SEQ ID NO: 57030 - DNA, 15 bp, Homo sapiens
cagacaaatggtacc

SEQ ID NO: 57031 - DNA, 15 bp, Homo sapiens
agacaaatggtacca

SEQ ID NO: 57032 - DNA, 15 bp, Homo sapiens
gacaaatggtaccat

SEQ ID NO: 57033 - DNA, 15 bp, Homo sapiens
acaaatggtaccatc

SEQ ID NO: 57034 - DNA, 15 bp, Homo sapiens
caaatggtaccatcc

SEQ ID NO: 57035 - DNA, 15 bp, Homo sapiens
aaatggtaccatcca

SEQ ID NO: 57036 - DNA, 15 bp, Homo sapiens
aatggtaccatccag

SEQ ID NO: 57037 - DNA, 15 bp, Homo sapiens
atggtaccatccagt

SEQ ID NO: 57038 - DNA, 15 bp, Homo sapiens
tggtaccatccagtt

SEQ ID NO: 57039 - DNA, 15 bp, Homo sapiens
ggtaccatccagtta

SEQ ID NO: 57040 - DNA, 15 bp, Homo sapiens
gtaccatccagttaa

SEQ ID NO: 57041 - DNA, 15 bp, Homo sapiens
taccatccagttaag

SEQ ID NO: 57042 - DNA, 15 bp, Homo sapiens
accatccagttaagc

SEQ ID NO: 57043 - DNA, 15 bp, Homo sapiens
ccatccagttaagcc

SEQ ID NO: 57044 - DNA, 15 bp, Homo sapiens
catccagttaagccc

SEQ ID NO: 57045 - DNA, 15 bp, Homo sapiens
atccagttaagcccg

SEQ ID NO: 57046 - DNA, 15 bp, Homo sapiens
tccagttaagcccgt

SEQ ID NO: 57047 - DNA, 15 bp, Homo sapiens
ccagttaagcccgtg

SEQ ID NO: 57048 - DNA, 15 bp, Homo sapiens
cagttaagcccgtga

SEQ ID NO: 57049 - DNA, 15 bp, Homo sapiens
agttaagcccgtgac

SEQ ID NO: 57050 - DNA, 15 bp, Homo sapiens
gttaagcccgtgaca

SEQ ID NO: 57051 - DNA, 15 bp, Homo sapiens
ttaagcccgtgacaa

SEQ ID NO: 57052 - DNA, 15 bp, Homo sapiens
taagcccgtgacaaa

SEQ ID NO: 57053 - DNA, 15 bp, Homo sapiens
aagcccgtgacaaaa

SEQ ID NO: 57054 - DNA, 15 bp, Homo sapiens
agcccgtgacaaaaa

SEQ ID NO: 57055 - DNA, 15 bp, Homo sapiens
gcccgtgacaaaaat

SEQ ID NO: 57056 - DNA, 15 bp, Homo sapiens
cccgtgacaaaaatg

SEQ ID NO: 57057 - DNA, 15 bp, Homo sapiens
ccgtgacaaaaatgg

SEQ ID NO: 57058 - DNA, 15 bp, Homo sapiens
cgtgacaaaaatgga

SEQ ID NO: 57059 - DNA, 15 bp, Homo sapiens
gtgacaaaaatggaa

SEQ ID NO: 57060 - DNA, 15 bp, Homo sapiens
tgacaaaaatggaaa

SEQ ID NO: 57061 - DNA, 15 bp, Homo sapiens
gacaaaaatggaaat

SEQ ID NO: 57062 - DNA, 15 bp, Homo sapiens
acaaaaatggaaatt

SEQ ID NO: 57063 - DNA, 15 bp, Homo sapiens
caaaaatggaaattt

SEQ ID NO: 57064 - DNA, 15 bp, Homo sapiens
aaaaatggaaatttc

SEQ ID NO: 57065 - DNA, 15 bp, Homo sapiens
aaaatggaaatttct

SEQ ID NO: 57066 - DNA, 15 bp, Homo sapiens
aaatggaaatttcta

SEQ ID NO: 57067 - DNA, 15 bp, Homo sapiens
aatggaaatttctaa

SEQ ID NO: 57068 - DNA, 15 bp, Homo sapiens
atggaaatttctaaa

SEQ ID NO: 57069 - DNA, 15 bp, Homo sapiens
tggaaatttctaaat

SEQ ID NO: 57070 - DNA, 15 bp, Homo sapiens
ggaaatttctaaata

SEQ ID NO: 57071 - DNA, 15 bp, Homo sapiens
gaaatttctaaatag

SEQ ID NO: 57072 - DNA, 15 bp, Homo sapiens
aaatttctaaatagc

SEQ ID NO: 57073 - DNA, 15 bp, Homo sapiens
aatttctaaatagcc

SEQ ID NO: 57074 - DNA, 15 bp, Homo sapiens
atttctaaatagccc

SEQ ID NO: 57075 - DNA, 15 bp, Homo sapiens
tttctaaatagccca

SEQ ID NO: 57076 - DNA, 15 bp, Homo sapiens
ttctaaatagcccaa

SEQ ID NO: 57077 - DNA, 15 bp, Homo sapiens
tctaaatagcccaag

SEQ ID NO: 57078 - DNA, 15 bp, Homo sapiens
ctaaatagcccaagt

SEQ ID NO: 57079 - DNA, 15 bp, Homo sapiens
taaatagcccaagtc

SEQ ID NO: 57080 - DNA, 15 bp, Homo sapiens
aaatagcccaagtct

SEQ ID NO: 57081 - DNA, 15 bp, Homo sapiens
aatagcccaagtctc

SEQ ID NO: 57082 - DNA, 15 bp, Homo sapiens
atagcccaagtctcc

SEQ ID NO: 57083 - DNA, 15 bp, Homo sapiens
tagcccaagtctcca

SEQ ID NO: 57084 - DNA, 15 bp, Homo sapiens
agcccaagtctccag

SEQ ID NO: 57085 - DNA, 15 bp, Homo sapiens
gcccaagtctccagg

SEQ ID NO: 57086 - DNA, 15 bp, Homo sapiens
cccaagtctccaggg

SEQ ID NO: 57087 - DNA, 15 bp, Homo sapiens
ccaagtctccagggc

SEQ ID NO: 57088 - DNA, 15 bp, Homo sapiens
caagtctccagggca

SEQ ID NO: 57089 - DNA, 15 bp, Homo sapiens
aagtctccagggcaa

SEQ ID NO: 57090 - DNA, 15 bp, Homo sapiens
agtctccagggcaat

SEQ ID NO: 57091 - DNA, 15 bp, Homo sapiens
gtctccagggcaatt

SEQ ID NO: 57092 - DNA, 15 bp, Homo sapiens
tctccagggcaattg

SEQ ID NO: 57093 - DNA, 15 bp, Homo sapiens
ctccagggcaattgg

SEQ ID NO: 57094 - DNA, 15 bp, Homo sapiens
tccagggcaattggg

SEQ ID NO: 57095 - DNA, 15 bp, Homo sapiens
ccagggcaattggga

SEQ ID NO: 57096 - DNA, 15 bp, Homo sapiens
cagggcaattgggaa

SEQ ID NO: 57097 - DNA, 15 bp, Homo sapiens
agggcaattgggaac

SEQ ID NO: 57098 - DNA, 15 bp, Homo sapiens
gggcaattgggaaca

SEQ ID NO: 57099 - DNA, 15 bp, Homo sapiens
ggcaattgggaacag

SEQ ID NO: 57100 - DNA, 15 bp, Homo sapiens
gcaattgggaacagc

SEQ ID NO: 57101 - DNA, 15 bp, Homo sapiens
caattgggaacagct

SEQ ID NO: 57102 - DNA, 15 bp, Homo sapiens
aattgggaacagctt

SEQ ID NO: 57103 - DNA, 15 bp, Homo sapiens
attgggaacagcttt

SEQ ID NO: 57104 - DNA, 15 bp, Homo sapiens
ttgggaacagctttg

SEQ ID NO: 57105 - DNA, 15 bp, Homo sapiens
tgggaacagctttga

SEQ ID NO: 57106 - DNA, 15 bp, Homo sapiens
gggaacagctttgaa

SEQ ID NO: 57107 - DNA, 15 bp, Homo sapiens
ggaacagctttgaac

SEQ ID NO: 57108 - DNA, 15 bp, Homo sapiens
gaacagctttgaacc

SEQ ID NO: 57109 - DNA, 15 bp, Homo sapiens
aacagctttgaaccc

SEQ ID NO: 57110 - DNA, 15 bp, Homo sapiens
acagctttgaaccca

SEQ ID NO: 57111 - DNA, 15 bp, Homo sapiens
cagctttgaacccac

SEQ ID NO: 57112 - DNA, 15 bp, Homo sapiens
agctttgaacccact

SEQ ID NO: 57113 - DNA, 15 bp, Homo sapiens
gctttgaacccacta

SEQ ID NO: 57114 - DNA, 15 bp, Homo sapiens
ctttgaacccactaa

SEQ ID NO: 57115 - DNA, 15 bp, Homo sapiens
tttgaacccactaag

SEQ ID NO: 57116 - DNA, 15 bp, Homo sapiens
ttgaacccactaaga

SEQ ID NO: 57117 - DNA, 15 bp, Homo sapiens
tgaacccactaagat

SEQ ID NO: 57118 - DNA, 15 bp, Homo sapiens
gaacccactaagatg

SEQ ID NO: 57119 - DNA, 15 bp, Homo sapiens
aacccactaagatgg

SEQ ID NO: 57120 - DNA, 15 bp, Homo sapiens
acccactaagatggg

SEQ ID NO: 57121 - DNA, 15 bp, Homo sapiens
cccactaagatgggg

SEQ ID NO: 57122 - DNA, 15 bp, Homo sapiens
ccactaagatggggt

SEQ ID NO: 57123 - DNA, 15 bp, Homo sapiens
cactaagatggggtc

SEQ ID NO: 57124 - DNA, 15 bp, Homo sapiens
actaagatggggtct

SEQ ID NO: 57125 - DNA, 15 bp, Homo sapiens
ctaagatggggtctg

SEQ ID NO: 57126 - DNA, 15 bp, Homo sapiens
taagatggggtctgc

SEQ ID NO: 57127 - DNA, 15 bp, Homo sapiens
aagatggggtctgct

SEQ ID NO: 57128 - DNA, 15 bp, Homo sapiens
agatggggtctgcta

SEQ ID NO: 57129 - DNA, 15 bp, Homo sapiens
gatggggtctgctat

SEQ ID NO: 57130 - DNA, 15 bp, Homo sapiens
atggggtctgctatg

SEQ ID NO: 57131 - DNA, 15 bp, Homo sapiens
tggggtctgctatgc

SEQ ID NO: 57132 - DNA, 15 bp, Homo sapiens
ggggtctgctatgcc

SEQ ID NO: 57133 - DNA, 15 bp, Homo sapiens
gggtctgctatgcca

SEQ ID NO: 57134 - DNA, 15 bp, Homo sapiens
ggtctgctatgccaa

SEQ ID NO: 57135 - DNA, 15 bp, Homo sapiens
gtctgctatgccaaa

SEQ ID NO: 57136 - DNA, 15 bp, Homo sapiens
tctgctatgccaaaa

SEQ ID NO: 57137 - DNA, 15 bp, Homo sapiens
ctgctatgccaaaac

SEQ ID NO: 57138 - DNA, 15 bp, Homo sapiens
tgctatgccaaaaca

SEQ ID NO: 57139 - DNA, 15 bp, Homo sapiens
gctatgccaaaacat

SEQ ID NO: 57140 - DNA, 15 bp, Homo sapiens
ctatgccaaaacata

SEQ ID NO: 57141 - DNA, 15 bp, Homo sapiens
tatgccaaaacatag

SEQ ID NO: 57142 - DNA, 15 bp, Homo sapiens
atgccaaaacataga

SEQ ID NO: 57143 - DNA, 15 bp, Homo sapiens
tgccaaaacatagat

SEQ ID NO: 57144 - DNA, 15 bp, Homo sapiens
gccaaaacatagata

SEQ ID NO: 57145 - DNA, 15 bp, Homo sapiens
ccaaaacatagatac

SEQ ID NO: 57146 - DNA, 15 bp, Homo sapiens
caaaacatagataca

SEQ ID NO: 57147 - DNA, 15 bp, Homo sapiens
aaaacatagatacag

SEQ ID NO: 57148 - DNA, 15 bp, Homo sapiens
aaacatagatacaga

SEQ ID NO: 57149 - DNA, 15 bp, Homo sapiens
aacatagatacagaa

SEQ ID NO: 57150 - DNA, 15 bp, Homo sapiens
acatagatacagaat

SEQ ID NO: 57151 - DNA, 15 bp, Homo sapiens
catagatacagaatt

SEQ ID NO: 57152 - DNA, 15 bp, Homo sapiens
atagatacagaattc

SEQ ID NO: 57153 - DNA, 15 bp, Homo sapiens
tagatacagaattca

SEQ ID NO: 57154 - DNA, 15 bp, Homo sapiens
agatacagaattcac

SEQ ID NO: 57155 - DNA, 15 bp, Homo sapiens
gatacagaattcaca

SEQ ID NO: 57156 - DNA, 15 bp, Homo sapiens
atacagaattcacag

SEQ ID NO: 57157 - DNA, 15 bp, Homo sapiens
tacagaattcacagt

SEQ ID NO: 57158 - DNA, 15 bp, Homo sapiens
acagaattcacagtt

SEQ ID NO: 57159 - DNA, 15 bp, Homo sapiens
cagaattcacagttt

SEQ ID NO: 57160 - DNA, 15 bp, Homo sapiens
agaattcacagtttg

SEQ ID NO: 57161 - DNA, 15 bp, Homo sapiens
gaattcacagtttgt

SEQ ID NO: 57162 - DNA, 15 bp, Homo sapiens
aattcacagtttgtc

SEQ ID NO: 57163 - DNA, 15 bp, Homo sapiens
attcacagtttgtcc

SEQ ID NO: 57164 - DNA, 15 bp, Homo sapiens
ttcacagtttgtcct

SEQ ID NO: 57165 - DNA, 15 bp, Homo sapiens
tcacagtttgtcctg

SEQ ID NO: 57166 - DNA, 15 bp, Homo sapiens
cacagtttgtcctgc

SEQ ID NO: 57167 - DNA, 15 bp, Homo sapiens
acagtttgtcctgca

SEQ ID NO: 57168 - DNA, 15 bp, Homo sapiens
cagtttgtcctgcat

SEQ ID NO: 57169 - DNA, 15 bp, Homo sapiens
agtttgtcctgcatt

SEQ ID NO: 57170 - DNA, 15 bp, Homo sapiens
gtttgtcctgcatta

SEQ ID NO: 57171 - DNA, 15 bp, Homo sapiens
tttgtcctgcattag

SEQ ID NO: 57172 - DNA, 15 bp, Homo sapiens
ttgtcctgcattagg

SEQ ID NO: 57173 - DNA, 15 bp, Homo sapiens
tgtcctgcattagga

SEQ ID NO: 57174 - DNA, 15 bp, Homo sapiens
gtcctgcattaggac

SEQ ID NO: 57175 - DNA, 15 bp, Homo sapiens
tcctgcattaggaca

SEQ ID NO: 57176 - DNA, 15 bp, Homo sapiens
cctgcattaggacat

SEQ ID NO: 57177 - DNA, 15 bp, Homo sapiens
ctgcattaggacatt

SEQ ID NO: 57178 - DNA, 15 bp, Homo sapiens
tgcattaggacattc

SEQ ID NO: 57179 - DNA, 15 bp, Homo sapiens
gcattaggacattct

SEQ ID NO: 57180 - DNA, 15 bp, Homo sapiens
cattaggacattctc

SEQ ID NO: 57181 - DNA, 15 bp, Homo sapiens
attaggacattctct

SEQ ID NO: 57182 - DNA, 15 bp, Homo sapiens
ttaggacattctctt

SEQ ID NO: 57183 - DNA, 15 bp, Homo sapiens
taggacattctcttc

SEQ ID NO: 57184 - DNA, 15 bp, Homo sapiens
aggacattctcttca

SEQ ID NO: 57185 - DNA, 15 bp, Homo sapiens
ggacattctcttcaa

SEQ ID NO: 57186 - DNA, 15 bp, Homo sapiens
gacattctcttcaac

SEQ ID NO: 57187 - DNA, 15 bp, Homo sapiens
acattctcttcaact

SEQ ID NO: 57188 - DNA, 15 bp, Homo sapiens
cattctcttcaactt

SEQ ID NO: 57189 - DNA, 15 bp, Homo sapiens
attctcttcaacttt

SEQ ID NO: 57190 - DNA, 15 bp, Homo sapiens
ttctcttcaactttg

SEQ ID NO: 57191 - DNA, 15 bp, Homo sapiens
tctcttcaactttgc

SEQ ID NO: 57192 - DNA, 15 bp, Homo sapiens
ctcttcaactttgcc

SEQ ID NO: 57193 - DNA, 15 bp, Homo sapiens
tcttcaactttgcca

SEQ ID NO: 57194 - DNA, 15 bp, Homo sapiens
cttcaactttgccac

SEQ ID NO: 57195 - DNA, 15 bp, Homo sapiens
ttcaactttgccact

SEQ ID NO: 57196 - DNA, 15 bp, Homo sapiens
tcaactttgccactg

SEQ ID NO: 57197 - DNA, 15 bp, Homo sapiens
caactttgccactgt

SEQ ID NO: 57198 - DNA, 15 bp, Homo sapiens
aactttgccactgta

SEQ ID NO: 57199 - DNA, 15 bp, Homo sapiens
actttgccactgtag

SEQ ID NO: 57200 - DNA, 15 bp, Homo sapiens
ctttgccactgtaga

SEQ ID NO: 57201 - DNA, 15 bp, Homo sapiens
tttgccactgtagaa

SEQ ID NO: 57202 - DNA, 15 bp, Homo sapiens
ttgccactgtagaaa

SEQ ID NO: 57203 - DNA, 15 bp, Homo sapiens
tgccactgtagaaag

SEQ ID NO: 57204 - DNA, 15 bp, Homo sapiens
gccactgtagaaagt

SEQ ID NO: 57205 - DNA, 15 bp, Homo sapiens
ccactgtagaaagtg

SEQ ID NO: 57206 - DNA, 15 bp, Homo sapiens
cactgtagaaagtgg

SEQ ID NO: 57207 - DNA, 15 bp, Homo sapiens
actgtagaaagtgga

SEQ ID NO: 57208 - DNA, 15 bp, Homo sapiens
ctgtagaaagtggag

SEQ ID NO: 57209 - DNA, 15 bp, Homo sapiens
tgtagaaagtggagg

SEQ ID NO: 57210 - DNA, 15 bp, Homo sapiens
gtagaaagtggaggt

SEQ ID NO: 57211 - DNA, 15 bp, Homo sapiens
tagaaagtggaggta

SEQ ID NO: 57212 - DNA, 15 bp, Homo sapiens
agaaagtggaggtag

SEQ ID NO: 57213 - DNA, 15 bp, Homo sapiens
gaaagtggaggtagg

SEQ ID NO: 57214 - DNA, 15 bp, Homo sapiens
aaagtggaggtaggt

SEQ ID NO: 57215 - DNA, 15 bp, Homo sapiens
aagtggaggtaggtc

SEQ ID NO: 57216 - DNA, 15 bp, Homo sapiens
agtggaggtaggtca

SEQ ID NO: 57217 - DNA, 15 bp, Homo sapiens
gtggaggtaggtcag

SEQ ID NO: 57218 - DNA, 15 bp, Homo sapiens
tggaggtaggtcagc

SEQ ID NO: 57219 - DNA, 15 bp, Homo sapiens
ggaggtaggtcagcg

SEQ ID NO: 57220 - DNA, 15 bp, Homo sapiens
gaggtaggtcagcgg

SEQ ID NO: 57221 - DNA, 15 bp, Homo sapiens
aggtaggtcagcgga

SEQ ID NO: 57222 - DNA, 15 bp, Homo sapiens
ggtaggtcagcggat

SEQ ID NO: 57223 - DNA, 15 bp, Homo sapiens
gtaggtcagcggatg

SEQ ID NO: 57224 - DNA, 15 bp, Homo sapiens
taggtcagcggatgg

SEQ ID NO: 57225 - DNA, 15 bp, Homo sapiens
aggtcagcggatggt

SEQ ID NO: 57226 - DNA, 15 bp, Homo sapiens
ggtcagcggatggtg

SEQ ID NO: 57227 - DNA, 15 bp, Homo sapiens
gtcagcggatggtgc

SEQ ID NO: 57228 - DNA, 15 bp, Homo sapiens
tcagcggatggtgcc

SEQ ID NO: 57229 - DNA, 15 bp, Homo sapiens
cagcggatggtgcca

SEQ ID NO: 57230 - DNA, 15 bp, Homo sapiens
agcggatggtgccac

SEQ ID NO: 57231 - DNA, 15 bp, Homo sapiens
gcggatggtgccaca

SEQ ID NO: 57232 - DNA, 15 bp, Homo sapiens
cggatggtgccacat

SEQ ID NO: 57233 - DNA, 15 bp, Homo sapiens
ggatggtgccacatt

SEQ ID NO: 57234 - DNA, 15 bp, Homo sapiens
gatggtgccacatta

SEQ ID NO: 57235 - DNA, 15 bp, Homo sapiens
atggtgccacattaa

SEQ ID NO: 57236 - DNA, 15 bp, Homo sapiens
tggtgccacattaac

SEQ ID NO: 57237 - DNA, 15 bp, Homo sapiens
ggtgccacattaaca

SEQ ID NO: 57238 - DNA, 15 bp, Homo sapiens
gtgccacattaacag

SEQ ID NO: 57239 - DNA, 15 bp, Homo sapiens
tgccacattaacagc

SEQ ID NO: 57240 - DNA, 15 bp, Homo sapiens
gccacattaacagcc

SEQ ID NO: 57241 - DNA, 15 bp, Homo sapiens
ccacattaacagccg

SEQ ID NO: 57242 - DNA, 15 bp, Homo sapiens
cacattaacagccgc

SEQ ID NO: 57243 - DNA, 15 bp, Homo sapiens
acattaacagccgcc

SEQ ID NO: 57244 - DNA, 15 bp, Homo sapiens
cattaacagccgcct

SEQ ID NO: 57245 - DNA, 15 bp, Homo sapiens
attaacagccgcctt

SEQ ID NO: 57246 - DNA, 15 bp, Homo sapiens
ttaacagccgcctta

SEQ ID NO: 57247 - DNA, 15 bp, Homo sapiens
taacagccgccttac

SEQ ID NO: 57248 - DNA, 15 bp, Homo sapiens
aacagccgccttact

SEQ ID NO: 57249 - DNA, 15 bp, Homo sapiens
acagccgccttactg

SEQ ID NO: 57250 - DNA, 15 bp, Homo sapiens
cagccgccttactga

SEQ ID NO: 57251 - DNA, 15 bp, Homo sapiens
agccgccttactgaa

SEQ ID NO: 57252 - DNA, 15 bp, Homo sapiens
gccgccttactgaag

SEQ ID NO: 57253 - DNA, 15 bp, Homo sapiens
ccgccttactgaagt

SEQ ID NO: 57254 - DNA, 15 bp, Homo sapiens
cgccttactgaagtg

SEQ ID NO: 57255 - DNA, 15 bp, Homo sapiens
gccttactgaagtgt

SEQ ID NO: 57256 - DNA, 15 bp, Homo sapiens
ccttactgaagtgta

SEQ ID NO: 57257 - DNA, 15 bp, Homo sapiens
cttactgaagtgtag

SEQ ID NO: 57258 - DNA, 15 bp, Homo sapiens
ttactgaagtgtagt

SEQ ID NO: 57259 - DNA, 15 bp, Homo sapiens
tactgaagtgtagtc

SEQ ID NO: 57260 - DNA, 15 bp, Homo sapiens
actgaagtgtagtcc

SEQ ID NO: 57261 - DNA, 15 bp, Homo sapiens
ctgaagtgtagtcca

SEQ ID NO: 57262 - DNA, 15 bp, Homo sapiens
tgaagtgtagtccaa

SEQ ID NO: 57263 - DNA, 15 bp, Homo sapiens
gaagtgtagtccaac

SEQ ID NO: 57264 - DNA, 15 bp, Homo sapiens
aagtgtagtccaaca

SEQ ID NO: 57265 - DNA, 15 bp, Homo sapiens
agtgtagtccaacag

SEQ ID NO: 57266 - DNA, 15 bp, Homo sapiens
gtgtagtccaacagg

SEQ ID NO: 57267 - DNA, 15 bp, Homo sapiens
tgtagtccaacaggg

SEQ ID NO: 57268 - DNA, 15 bp, Homo sapiens
gtagtccaacagggt

SEQ ID NO: 57269 - DNA, 15 bp, Homo sapiens
tagtccaacagggtc

SEQ ID NO: 57270 - DNA, 15 bp, Homo sapiens
agtccaacagggtct

SEQ ID NO: 57271 - DNA, 15 bp, Homo sapiens
gtccaacagggtctt

SEQ ID NO: 57272 - DNA, 15 bp, Homo sapiens
tccaacagggtctta

SEQ ID NO: 57273 - DNA, 15 bp, Homo sapiens
ccaacagggtcttac

SEQ ID NO: 57274 - DNA, 15 bp, Homo sapiens
caacagggtcttact

SEQ ID NO: 57275 - DNA, 15 bp, Homo sapiens
aacagggtcttactg

SEQ ID NO: 57276 - DNA, 15 bp, Homo sapiens
acagggtcttactgc

SEQ ID NO: 57277 - DNA, 15 bp, Homo sapiens
cagggtcttactgcc

SEQ ID NO: 57278 - DNA, 15 bp, Homo sapiens
agggtcttactgcca

SEQ ID NO: 57279 - DNA, 15 bp, Homo sapiens
gggtcttactgccac

SEQ ID NO: 57280 - DNA, 15 bp, Homo sapiens
ggtcttactgccact

SEQ ID NO: 57281 - DNA, 15 bp, Homo sapiens
gtcttactgccactg

SEQ ID NO: 57282 - DNA, 15 bp, Homo sapiens
tcttactgccactgt

SEQ ID NO: 57283 - DNA, 15 bp, Homo sapiens
cttactgccactgtg

SEQ ID NO: 57284 - DNA, 15 bp, Homo sapiens
ttactgccactgtga

SEQ ID NO: 57285 - DNA, 15 bp, Homo sapiens
tactgccactgtgac

SEQ ID NO: 57286 - DNA, 15 bp, Homo sapiens
actgccactgtgaca

SEQ ID NO: 57287 - DNA, 15 bp, Homo sapiens
ctgccactgtgacac

SEQ ID NO: 57288 - DNA, 15 bp, Homo sapiens
tgccactgtgacacg

SEQ ID NO: 57289 - DNA, 15 bp, Homo sapiens
gccactgtgacacgt

SEQ ID NO: 57290 - DNA, 15 bp, Homo sapiens
ccactgtgacacgtg

SEQ ID NO: 57291 - DNA, 15 bp, Homo sapiens
cactgtgacacgtgc

SEQ ID NO: 57292 - DNA, 15 bp, Homo sapiens
actgtgacacgtgcc

SEQ ID NO: 57293 - DNA, 15 bp, Homo sapiens
ctgtgacacgtgcct

SEQ ID NO: 57294 - DNA, 15 bp, Homo sapiens
tgtgacacgtgcctt

SEQ ID NO: 57295 - DNA, 15 bp, Homo sapiens
gtgacacgtgccttg

SEQ ID NO: 57296 - DNA, 15 bp, Homo sapiens
tgacacgtgccttgc

SEQ ID NO: 57297 - DNA, 15 bp, Homo sapiens
gacacgtgccttgcc

SEQ ID NO: 57298 - DNA, 15 bp, Homo sapiens
acacgtgccttgcct

SEQ ID NO: 57299 - DNA, 15 bp, Homo sapiens
cacgtgccttgcctt

SEQ ID NO: 57300 - DNA, 15 bp, Homo sapiens
acgtgccttgccttg

SEQ ID NO: 57301 - DNA, 15 bp, Homo sapiens
cgtgccttgccttgg

SEQ ID NO: 57302 - DNA, 15 bp, Homo sapiens
gtgccttgccttggg

SEQ ID NO: 57303 - DNA, 15 bp, Homo sapiens
tgccttgccttgggg

SEQ ID NO: 57304 - DNA, 15 bp, Homo sapiens
gccttgccttggggg

SEQ ID NO: 57305 - DNA, 15 bp, Homo sapiens
ccttgccttgggggt

SEQ ID NO: 57306 - DNA, 15 bp, Homo sapiens
cttgccttgggggtg

SEQ ID NO: 57307 - DNA, 15 bp, Homo sapiens
ttgccttgggggtgc

SEQ ID NO: 57308 - DNA, 15 bp, Homo sapiens
tgccttgggggtgcg

SEQ ID NO: 57309 - DNA, 15 bp, Homo sapiens
gccttgggggtgcgt

SEQ ID NO: 57310 - DNA, 15 bp, Homo sapiens
ccttgggggtgcgtt

SEQ ID NO: 57311 - DNA, 15 bp, Homo sapiens
cttgggggtgcgttt

SEQ ID NO: 57312 - DNA, 15 bp, Homo sapiens
ttgggggtgcgtttc

SEQ ID NO: 57313 - DNA, 15 bp, Homo sapiens
tgggggtgcgtttcc

SEQ ID NO: 57314 - DNA, 15 bp, Homo sapiens
gggggtgcgtttccc

SEQ ID NO: 57315 - DNA, 15 bp, Homo sapiens
ggggtgcgtttcccc

SEQ ID NO: 57316 - DNA, 15 bp, Homo sapiens
gggtgcgtttcccca

SEQ ID NO: 57317 - DNA, 15 bp, Homo sapiens
ggtgcgtttccccac

SEQ ID NO: 57318 - DNA, 15 bp, Homo sapiens
gtgcgtttccccacc

SEQ ID NO: 57319 - DNA, 15 bp, Homo sapiens
tgcgtttccccacct

SEQ ID NO: 57320 - DNA, 15 bp, Homo sapiens
gcgtttccccacctc

SEQ ID NO: 57321 - DNA, 15 bp, Homo sapiens
cgtttccccacctct

SEQ ID NO: 57322 - DNA, 15 bp, Homo sapiens
gtttccccacctctc

SEQ ID NO: 57323 - DNA, 15 bp, Homo sapiens
tttccccacctctcc

SEQ ID NO: 57324 - DNA, 15 bp, Homo sapiens
ttccccacctctcct

SEQ ID NO: 57325 - DNA, 15 bp, Homo sapiens
tccccacctctcctt

SEQ ID NO: 57326 - DNA, 15 bp, Homo sapiens
ccccacctctccttg

SEQ ID NO: 57327 - DNA, 15 bp, Homo sapiens
cccacctctccttgc

SEQ ID NO: 57328 - DNA, 15 bp, Homo sapiens
ccacctctccttgct

SEQ ID NO: 57329 - DNA, 15 bp, Homo sapiens
cacctctccttgctc

SEQ ID NO: 57330 - DNA, 15 bp, Homo sapiens
acctctccttgctct

SEQ ID NO: 57331 - DNA, 15 bp, Homo sapiens
cctctccttgctctg

SEQ ID NO: 57332 - DNA, 15 bp, Homo sapiens
ctctccttgctctgc

SEQ ID NO: 57333 - DNA, 15 bp, Homo sapiens
tctccttgctctgca

SEQ ID NO: 57334 - DNA, 15 bp, Homo sapiens
ctccttgctctgcag

SEQ ID NO: 57335 - DNA, 15 bp, Homo sapiens
tccttgctctgcagc

SEQ ID NO: 57336 - DNA, 15 bp, Homo sapiens
ccttgctctgcagct

SEQ ID NO: 57337 - DNA, 15 bp, Homo sapiens
cttgctctgcagctt

SEQ ID NO: 57338 - DNA, 15 bp, Homo sapiens
ttgctctgcagcttg

SEQ ID NO: 57339 - DNA, 15 bp, Homo sapiens
tgctctgcagcttgt

SEQ ID NO: 57340 - DNA, 15 bp, Homo sapiens
gctctgcagcttgtc

SEQ ID NO: 57341 - DNA, 15 bp, Homo sapiens
ctctgcagcttgtcc

SEQ ID NO: 57342 - DNA, 15 bp, Homo sapiens
tctgcagcttgtccg

SEQ ID NO: 57343 - DNA, 15 bp, Homo sapiens
ctgcagcttgtccga

SEQ ID NO: 57344 - DNA, 15 bp, Homo sapiens
tgcagcttgtccgaa

SEQ ID NO: 57345 - DNA, 15 bp, Homo sapiens
gcagcttgtccgaaa

SEQ ID NO: 57346 - DNA, 15 bp, Homo sapiens
cagcttgtccgaaaa

SEQ ID NO: 57347 - DNA, 15 bp, Homo sapiens
agcttgtccgaaaac

SEQ ID NO: 57348 - DNA, 15 bp, Homo sapiens
gcttgtccgaaaacc

SEQ ID NO: 57349 - DNA, 15 bp, Homo sapiens
cttgtccgaaaacca

SEQ ID NO: 57350 - DNA, 15 bp, Homo sapiens
ttgtccgaaaaccag

SEQ ID NO: 57351 - DNA, 15 bp, Homo sapiens
tgtccgaaaaccagt

SEQ ID NO: 57352 - DNA, 15 bp, Homo sapiens
gtccgaaaaccagtc

SEQ ID NO: 57353 - DNA, 15 bp, Homo sapiens
tccgaaaaccagtcc

SEQ ID NO: 57354 - DNA, 15 bp, Homo sapiens
ccgaaaaccagtcct

SEQ ID NO: 57355 - DNA, 15 bp, Homo sapiens
cgaaaaccagtcctt

SEQ ID NO: 57356 - DNA, 15 bp, Homo sapiens
gaaaaccagtccttg

SEQ ID NO: 57357 - DNA, 15 bp, Homo sapiens
aaaaccagtccttgc

SEQ ID NO: 57358 - DNA, 15 bp, Homo sapiens
aaaccagtccttgct

SEQ ID NO: 57359 - DNA, 15 bp, Homo sapiens
aaccagtccttgctg

SEQ ID NO: 57360 - DNA, 15 bp, Homo sapiens
accagtccttgctga

SEQ ID NO: 57361 - DNA, 15 bp, Homo sapiens
ccagtccttgctgag

SEQ ID NO: 57362 - DNA, 15 bp, Homo sapiens
cagtccttgctgagg

SEQ ID NO: 57363 - DNA, 15 bp, Homo sapiens
agtccttgctgagga

SEQ ID NO: 57364 - DNA, 15 bp, Homo sapiens
gtccttgctgaggat

SEQ ID NO: 57365 - DNA, 15 bp, Homo sapiens
tccttgctgaggatg

SEQ ID NO: 57366 - DNA, 15 bp, Homo sapiens
ccttgctgaggatgc

SEQ ID NO: 57367 - DNA, 15 bp, Homo sapiens
cttgctgaggatgcc

SEQ ID NO: 57368 - DNA, 15 bp, Homo sapiens
ttgctgaggatgccc

SEQ ID NO: 57369 - DNA, 15 bp, Homo sapiens
tgctgaggatgcccc

SEQ ID NO: 57370 - DNA, 15 bp, Homo sapiens
gctgaggatgccccc

SEQ ID NO: 57371 - DNA, 15 bp, Homo sapiens
ctgaggatgcccccc

SEQ ID NO: 57372 - DNA, 15 bp, Homo sapiens
tgaggatgcccccct

SEQ ID NO: 57373 - DNA, 15 bp, Homo sapiens
gaggatgcccccctg

SEQ ID NO: 57374 - DNA, 15 bp, Homo sapiens
aggatgcccccctgg

SEQ ID NO: 57375 - DNA, 15 bp, Homo sapiens
ggatgcccccctggg

SEQ ID NO: 57376 - DNA, 15 bp, Homo sapiens
gatgcccccctggga

SEQ ID NO: 57377 - DNA, 15 bp, Homo sapiens
atgcccccctgggag

SEQ ID NO: 57378 - DNA, 15 bp, Homo sapiens
tgcccccctgggaga

SEQ ID NO: 57379 - DNA, 15 bp, Homo sapiens
gcccccctgggagaa

SEQ ID NO: 57380 - DNA, 15 bp, Homo sapiens
cccccctgggagaac

SEQ ID NO: 57381 - DNA, 15 bp, Homo sapiens
ccccctgggagaaca

SEQ ID NO: 57382 - DNA, 15 bp, Homo sapiens
cccctgggagaacat

SEQ ID NO: 57383 - DNA, 15 bp, Homo sapiens
ccctgggagaacatc

SEQ ID NO: 57384 - DNA, 15 bp, Homo sapiens
cctgggagaacatct

SEQ ID NO: 57385 - DNA, 15 bp, Homo sapiens
ctgggagaacatctg

SEQ ID NO: 57386 - DNA, 15 bp, Homo sapiens
tgggagaacatctgg

SEQ ID NO: 57387 - DNA, 15 bp, Homo sapiens
gggagaacatctggc

SEQ ID NO: 57388 - DNA, 15 bp, Homo sapiens
ggagaacatctggct

SEQ ID NO: 57389 - DNA, 15 bp, Homo sapiens
gagaacatctggctc

SEQ ID NO: 57390 - DNA, 15 bp, Homo sapiens
agaacatctggctcg

SEQ ID NO: 57391 - DNA, 15 bp, Homo sapiens
gaacatctggctcgt

SEQ ID NO: 57392 - DNA, 15 bp, Homo sapiens
aacatctggctcgtg

SEQ ID NO: 57393 - DNA, 15 bp, Homo sapiens
acatctggctcgtgg

SEQ ID NO: 57394 - DNA, 15 bp, Homo sapiens
catctggctcgtggg

SEQ ID NO: 57395 - DNA, 15 bp, Homo sapiens
atctggctcgtgggc

SEQ ID NO: 57396 - DNA, 15 bp, Homo sapiens
tctggctcgtgggct

SEQ ID NO: 57397 - DNA, 15 bp, Homo sapiens
ctggctcgtgggctc

SEQ ID NO: 57398 - DNA, 15 bp, Homo sapiens
tggctcgtgggctcc

SEQ ID NO: 57399 - DNA, 15 bp, Homo sapiens
ggctcgtgggctcca

SEQ ID NO: 57400 - DNA, 15 bp, Homo sapiens
gctcgtgggctccat

SEQ ID NO: 57401 - DNA, 15 bp, Homo sapiens
ctcgtgggctccatc

SEQ ID NO: 57402 - DNA, 15 bp, Homo sapiens
tcgtgggctccatct

SEQ ID NO: 57403 - DNA, 15 bp, Homo sapiens
cgtgggctccatctg

SEQ ID NO: 57404 - DNA, 15 bp, Homo sapiens
gtgggctccatctgc

SEQ ID NO: 57405 - DNA, 15 bp, Homo sapiens
tgggctccatctgcc

SEQ ID NO: 57406 - DNA, 15 bp, Homo sapiens
gggctccatctgcct

SEQ ID NO: 57407 - DNA, 15 bp, Homo sapiens
ggctccatctgcctg

SEQ ID NO: 57408 - DNA, 15 bp, Homo sapiens
gctccatctgcctgt

SEQ ID NO: 57409 - DNA, 15 bp, Homo sapiens
ctccatctgcctgtc

SEQ ID NO: 57410 - DNA, 15 bp, Homo sapiens
tccatctgcctgtcc

SEQ ID NO: 57411 - DNA, 15 bp, Homo sapiens
ccatctgcctgtcca

SEQ ID NO: 57412 - DNA, 15 bp, Homo sapiens
catctgcctgtccat

SEQ ID NO: 57413 - DNA, 15 bp, Homo sapiens
atctgcctgtccatg

SEQ ID NO: 57414 - DNA, 15 bp, Homo sapiens
tctgcctgtccatgt

SEQ ID NO: 57415 - DNA, 15 bp, Homo sapiens
ctgcctgtccatgtc

SEQ ID NO: 57416 - DNA, 15 bp, Homo sapiens
tgcctgtccatgtca

SEQ ID NO: 57417 - DNA, 15 bp, Homo sapiens
gcctgtccatgtcac

SEQ ID NO: 57418 - DNA, 15 bp, Homo sapiens
cctgtccatgtcact

SEQ ID NO: 57419 - DNA, 15 bp, Homo sapiens
ctgtccatgtcactc

SEQ ID NO: 57420 - DNA, 15 bp, Homo sapiens
tgtccatgtcactcc

SEQ ID NO: 57421 - DNA, 15 bp, Homo sapiens
gtccatgtcactcca

SEQ ID NO: 57422 - DNA, 15 bp, Homo sapiens
tccatgtcactccac

SEQ ID NO: 57423 - DNA, 15 bp, Homo sapiens
ccatgtcactccact

SEQ ID NO: 57424 - DNA, 15 bp, Homo sapiens
catgtcactccactt

SEQ ID NO: 57425 - DNA, 15 bp, Homo sapiens
atgtcactccacttc

SEQ ID NO: 57426 - DNA, 15 bp, Homo sapiens
tgtcactccacttcc

SEQ ID NO: 57427 - DNA, 15 bp, Homo sapiens
gtcactccacttcct

SEQ ID NO: 57428 - DNA, 15 bp, Homo sapiens
tcactccacttcctg

SEQ ID NO: 57429 - DNA, 15 bp, Homo sapiens
cactccacttcctga

SEQ ID NO: 57430 - DNA, 15 bp, Homo sapiens
actccacttcctgat

SEQ ID NO: 57431 - DNA, 15 bp, Homo sapiens
ctccacttcctgatc

SEQ ID NO: 57432 - DNA, 15 bp, Homo sapiens
tccacttcctgatcc

SEQ ID NO: 57433 - DNA, 15 bp, Homo sapiens
ccacttcctgatcct

SEQ ID NO: 57434 - DNA, 15 bp, Homo sapiens
cacttcctgatcctc

SEQ ID NO: 57435 - DNA, 15 bp, Homo sapiens
acttcctgatcctct

SEQ ID NO: 57436 - DNA, 15 bp, Homo sapiens
cttcctgatcctcta

SEQ ID NO: 57437 - DNA, 15 bp, Homo sapiens
ttcctgatcctctat

SEQ ID NO: 57438 - DNA, 15 bp, Homo sapiens
tcctgatcctctatg

SEQ ID NO: 57439 - DNA, 15 bp, Homo sapiens
cctgatcctctatgt

SEQ ID NO: 57440 - DNA, 15 bp, Homo sapiens
ctgatcctctatgtc

SEQ ID NO: 57441 - DNA, 15 bp, Homo sapiens
tgatcctctatgtcg

SEQ ID NO: 57442 - DNA, 15 bp, Homo sapiens
gatcctctatgtcga

SEQ ID NO: 57443 - DNA, 15 bp, Homo sapiens
atcctctatgtcgaa

SEQ ID NO: 57444 - DNA, 15 bp, Homo sapiens
tcctctatgtcgaac

SEQ ID NO: 57445 - DNA, 15 bp, Homo sapiens
cctctatgtcgaacc

SEQ ID NO: 57446 - DNA, 15 bp, Homo sapiens
ctctatgtcgaaccc

SEQ ID NO: 57447 - DNA, 15 bp, Homo sapiens
tctatgtcgaaccct

SEQ ID NO: 57448 - DNA, 15 bp, Homo sapiens
ctatgtcgaaccctt

SEQ ID NO: 57449 - DNA, 15 bp, Homo sapiens
tatgtcgaacccttg

SEQ ID NO: 57450 - DNA, 15 bp, Homo sapiens
atgtcgaacccttgc

SEQ ID NO: 57451 - DNA, 15 bp, Homo sapiens
tgtcgaacccttgcc

SEQ ID NO: 57452 - DNA, 15 bp, Homo sapiens
gtcgaacccttgcca

SEQ ID NO: 57453 - DNA, 15 bp, Homo sapiens
tcgaacccttgccag

SEQ ID NO: 57454 - DNA, 15 bp, Homo sapiens
cgaacccttgccagt

SEQ ID NO: 57455 - DNA, 15 bp, Homo sapiens
gaacccttgccagta

SEQ ID NO: 57456 - DNA, 15 bp, Homo sapiens
aacccttgccagtaa

SEQ ID NO: 57457 - DNA, 15 bp, Homo sapiens
acccttgccagtaag

SEQ ID NO: 57458 - DNA, 15 bp, Homo sapiens
cccttgccagtaagt

SEQ ID NO: 57459 - DNA, 15 bp, Homo sapiens
ccttgccagtaagtg

SEQ ID NO: 57460 - DNA, 15 bp, Homo sapiens
cttgccagtaagtgg

SEQ ID NO: 57461 - DNA, 15 bp, Homo sapiens
ttgccagtaagtggt

SEQ ID NO: 57462 - DNA, 15 bp, Homo sapiens
tgccagtaagtggtt

SEQ ID NO: 57463 - DNA, 15 bp, Homo sapiens
gccagtaagtggttg

SEQ ID NO: 57464 - DNA, 15 bp, Homo sapiens
ccagtaagtggttgg

SEQ ID NO: 57465 - DNA, 15 bp, Homo sapiens
cagtaagtggttggg

SEQ ID NO: 57466 - DNA, 15 bp, Homo sapiens
agtaagtggttgggt

SEQ ID NO: 57467 - DNA, 15 bp, Homo sapiens
gtaagtggttgggtg

SEQ ID NO: 57468 - DNA, 15 bp, Homo sapiens
taagtggttgggtgg

SEQ ID NO: 57469 - DNA, 15 bp, Homo sapiens
aagtggttgggtggg

SEQ ID NO: 57470 - DNA, 15 bp, Homo sapiens
agtggttgggtgggg

SEQ ID NO: 57471 - DNA, 15 bp, Homo sapiens
gtggttgggtggggc

SEQ ID NO: 57472 - DNA, 15 bp, Homo sapiens
tggttgggtggggct

SEQ ID NO: 57473 - DNA, 15 bp, Homo sapiens
ggttgggtggggctt

SEQ ID NO: 57474 - DNA, 15 bp, Homo sapiens
gttgggtggggcttg

SEQ ID NO: 57475 - DNA, 15 bp, Homo sapiens
ttgggtggggcttgg

SEQ ID NO: 57476 - DNA, 15 bp, Homo sapiens
tgggtggggcttggg

SEQ ID NO: 57477 - DNA, 15 bp, Homo sapiens
gggtggggcttggga

SEQ ID NO: 57478 - DNA, 15 bp, Homo sapiens
ggtggggcttgggac

SEQ ID NO: 57479 - DNA, 15 bp, Homo sapiens
gtggggcttgggacc

SEQ ID NO: 57480 - DNA, 15 bp, Homo sapiens
tggggcttgggacca

SEQ ID NO: 57481 - DNA, 15 bp, Homo sapiens
ggggcttgggaccag

SEQ ID NO: 57482 - DNA, 15 bp, Homo sapiens
gggcttgggaccagc

SEQ ID NO: 57483 - DNA, 15 bp, Homo sapiens
ggcttgggaccagcc

SEQ ID NO: 57484 - DNA, 15 bp, Homo sapiens
gcttgggaccagcca

SEQ ID NO: 57485 - DNA, 15 bp, Homo sapiens
cttgggaccagccac

SEQ ID NO: 57486 - DNA, 15 bp, Homo sapiens
ttgggaccagccacc

SEQ ID NO: 57487 - DNA, 15 bp, Homo sapiens
tgggaccagccacct

SEQ ID NO: 57488 - DNA, 15 bp, Homo sapiens
gggaccagccacctc

SEQ ID NO: 57489 - DNA, 15 bp, Homo sapiens
ggaccagccacctcc

SEQ ID NO: 57490 - DNA, 15 bp, Homo sapiens
gaccagccacctcct

SEQ ID NO: 57491 - DNA, 15 bp, Homo sapiens
accagccacctcctt

SEQ ID NO: 57492 - DNA, 15 bp, Homo sapiens
ccagccacctccttc

SEQ ID NO: 57493 - DNA, 15 bp, Homo sapiens
cagccacctccttcc

SEQ ID NO: 57494 - DNA, 15 bp, Homo sapiens
agccacctccttcca

SEQ ID NO: 57495 - DNA, 15 bp, Homo sapiens
gccacctccttccag

SEQ ID NO: 57496 - DNA, 15 bp, Homo sapiens
ccacctccttccagg

SEQ ID NO: 57497 - DNA, 15 bp, Homo sapiens
cacctccttccaggg

SEQ ID NO: 57498 - DNA, 15 bp, Homo sapiens
acctccttccagggg

SEQ ID NO: 57499 - DNA, 15 bp, Homo sapiens
cctccttccagggga

SEQ ID NO: 57500 - DNA, 15 bp, Homo sapiens
ctccttccaggggag

SEQ ID NO: 57501 - DNA, 15 bp, Homo sapiens
tccttccaggggagg

SEQ ID NO: 57502 - DNA, 15 bp, Homo sapiens
ccttccaggggaggc

SEQ ID NO: 57503 - DNA, 15 bp, Homo sapiens
cttccaggggaggct

SEQ ID NO: 57504 - DNA, 15 bp, Homo sapiens
ttccaggggaggctg

SEQ ID NO: 57505 - DNA, 15 bp, Homo sapiens
tccaggggaggctgg

SEQ ID NO: 57506 - DNA, 15 bp, Homo sapiens
ccaggggaggctgga

SEQ ID NO: 57507 - DNA, 15 bp, Homo sapiens
caggggaggctggag

SEQ ID NO: 57508 - DNA, 15 bp, Homo sapiens
aggggaggctggagg

SEQ ID NO: 57509 - DNA, 15 bp, Homo sapiens
ggggaggctggaggc

SEQ ID NO: 57510 - DNA, 15 bp, Homo sapiens
gggaggctggaggcg

SEQ ID NO: 57511 - DNA, 15 bp, Homo sapiens
ggaggctggaggcgt

SEQ ID NO: 57512 - DNA, 15 bp, Homo sapiens
gaggctggaggcgtg

SEQ ID NO: 57513 - DNA, 15 bp, Homo sapiens
aggctggaggcgtga

SEQ ID NO: 57514 - DNA, 15 bp, Homo sapiens
ggctggaggcgtgac

SEQ ID NO: 57515 - DNA, 15 bp, Homo sapiens
gctggaggcgtgaca

SEQ ID NO: 57516 - DNA, 15 bp, Homo sapiens
ctggaggcgtgacac

SEQ ID NO: 57517 - DNA, 15 bp, Homo sapiens
tggaggcgtgacacg

SEQ ID NO: 57518 - DNA, 15 bp, Homo sapiens
ggaggcgtgacacgt

SEQ ID NO: 57519 - DNA, 15 bp, Homo sapiens
gaggcgtgacacgtc

SEQ ID NO: 57520 - DNA, 15 bp, Homo sapiens
aggcgtgacacgtct

SEQ ID NO: 57521 - DNA, 15 bp, Homo sapiens
ggcgtgacacgtctt

SEQ ID NO: 57522 - DNA, 15 bp, Homo sapiens
gcgtgacacgtcttc

SEQ ID NO: 57523 - DNA, 15 bp, Homo sapiens
cgtgacacgtcttcc

SEQ ID NO: 57524 - DNA, 15 bp, Homo sapiens
gtgacacgtcttccc

SEQ ID NO: 57525 - DNA, 15 bp, Homo sapiens
tgacacgtcttccct

SEQ ID NO: 57526 - DNA, 15 bp, Homo sapiens
gacacgtcttccctg

SEQ ID NO: 57527 - DNA, 15 bp, Homo sapiens
acacgtcttccctgt

SEQ ID NO: 57528 - DNA, 15 bp, Homo sapiens
cacgtcttccctgtg

SEQ ID NO: 57529 - DNA, 15 bp, Homo sapiens
acgtcttccctgtgt

SEQ ID NO: 57530 - DNA, 15 bp, Homo sapiens
cgtcttccctgtgtg

SEQ ID NO: 57531 - DNA, 15 bp, Homo sapiens
gtcttccctgtgtgt

SEQ ID NO: 57532 - DNA, 15 bp, Homo sapiens
tcttccctgtgtgtc

SEQ ID NO: 57533 - DNA, 15 bp, Homo sapiens
cttccctgtgtgtca

SEQ ID NO: 57534 - DNA, 15 bp, Homo sapiens
ttccctgtgtgtcag

SEQ ID NO: 57535 - DNA, 15 bp, Homo sapiens
tccctgtgtgtcagc

SEQ ID NO: 57536 - DNA, 15 bp, Homo sapiens
ccctgtgtgtcagct

SEQ ID NO: 57537 - DNA, 15 bp, Homo sapiens
cctgtgtgtcagctc

SEQ ID NO: 57538 - DNA, 15 bp, Homo sapiens
ctgtgtgtcagctca

SEQ ID NO: 57539 - DNA, 15 bp, Homo sapiens
tgtgtgtcagctcat

SEQ ID NO: 57540 - DNA, 15 bp, Homo sapiens
gtgtgtcagctcatc

SEQ ID NO: 57541 - DNA, 15 bp, Homo sapiens
tgtgtcagctcatct

SEQ ID NO: 57542 - DNA, 15 bp, Homo sapiens
gtgtcagctcatctt

SEQ ID NO: 57543 - DNA, 15 bp, Homo sapiens
tgtcagctcatcttc

SEQ ID NO: 57544 - DNA, 15 bp, Homo sapiens
gtcagctcatcttcc

SEQ ID NO: 57545 - DNA, 15 bp, Homo sapiens
tcagctcatcttcca

SEQ ID NO: 57546 - DNA, 15 bp, Homo sapiens
cagctcatcttccag

SEQ ID NO: 57547 - DNA, 15 bp, Homo sapiens
agctcatcttccaga

SEQ ID NO: 57548 - DNA, 15 bp, Homo sapiens
gctcatcttccagat

SEQ ID NO: 57549 - DNA, 15 bp, Homo sapiens
ctcatcttccagatc

SEQ ID NO: 57550 - DNA, 15 bp, Homo sapiens
tcatcttccagatca

SEQ ID NO: 57551 - DNA, 15 bp, Homo sapiens
catcttccagatcac

SEQ ID NO: 57552 - DNA, 15 bp, Homo sapiens
atcttccagatcaca

SEQ ID NO: 57553 - DNA, 15 bp, Homo sapiens
tcttccagatcacac

SEQ ID NO: 57554 - DNA, 15 bp, Homo sapiens
cttccagatcacacc

SEQ ID NO: 57555 - DNA, 15 bp, Homo sapiens
ttccagatcacaccg

SEQ ID NO: 57556 - DNA, 15 bp, Homo sapiens
tccagatcacaccgc

SEQ ID NO: 57557 - DNA, 15 bp, Homo sapiens
ccagatcacaccgct

SEQ ID NO: 57558 - DNA, 15 bp, Homo sapiens
cagatcacaccgctg

SEQ ID NO: 57559 - DNA, 15 bp, Homo sapiens
agatcacaccgctga

SEQ ID NO: 57560 - DNA, 15 bp, Homo sapiens
gatcacaccgctgaa

SEQ ID NO: 57561 - DNA, 15 bp, Homo sapiens
atcacaccgctgaac

SEQ ID NO: 57562 - DNA, 15 bp, Homo sapiens
tcacaccgctgaacg

SEQ ID NO: 57563 - DNA, 15 bp, Homo sapiens
cacaccgctgaacgt

SEQ ID NO: 57564 - DNA, 15 bp, Homo sapiens
acaccgctgaacgtg

SEQ ID NO: 57565 - DNA, 15 bp, Homo sapiens
caccgctgaacgtga

SEQ ID NO: 57566 - DNA, 15 bp, Homo sapiens
accgctgaacgtgac

SEQ ID NO: 57567 - DNA, 15 bp, Homo sapiens
ccgctgaacgtgacc

SEQ ID NO: 57568 - DNA, 15 bp, Homo sapiens
cgctgaacgtgaccc

SEQ ID NO: 57569 - DNA, 15 bp, Homo sapiens
gctgaacgtgaccca

SEQ ID NO: 57570 - DNA, 15 bp, Homo sapiens
ctgaacgtgacccag

SEQ ID NO: 57571 - DNA, 15 bp, Homo sapiens
tgaacgtgacccagt

SEQ ID NO: 57572 - DNA, 15 bp, Homo sapiens
gaacgtgacccagtg

SEQ ID NO: 57573 - DNA, 15 bp, Homo sapiens
aacgtgacccagtgg

SEQ ID NO: 57574 - DNA, 15 bp, Homo sapiens
acgtgacccagtggc

SEQ ID NO: 57575 - DNA, 15 bp, Homo sapiens
cgtgacccagtggct

SEQ ID NO: 57576 - DNA, 15 bp, Homo sapiens
gtgacccagtggctg

SEQ ID NO: 57577 - DNA, 15 bp, Homo sapiens
tgacccagtggctga

SEQ ID NO: 57578 - DNA, 15 bp, Homo sapiens
gacccagtggctgat

SEQ ID NO: 57579 - DNA, 15 bp, Homo sapiens
acccagtggctgatg

SEQ ID NO: 57580 - DNA, 15 bp, Homo sapiens
cccagtggctgatgg

SEQ ID NO: 57581 - DNA, 15 bp, Homo sapiens
ccagtggctgatggt

SEQ ID NO: 57582 - DNA, 15 bp, Homo sapiens
cagtggctgatggtg

SEQ ID NO: 57583 - DNA, 15 bp, Homo sapiens
agtggctgatggtgc

SEQ ID NO: 57584 - DNA, 15 bp, Homo sapiens
gtggctgatggtgct

SEQ ID NO: 57585 - DNA, 15 bp, Homo sapiens
tggctgatggtgctg

SEQ ID NO: 57586 - DNA, 15 bp, Homo sapiens
ggctgatggtgctga

SEQ ID NO: 57587 - DNA, 15 bp, Homo sapiens
gctgatggtgctgaa

SEQ ID NO: 57588 - DNA, 15 bp, Homo sapiens
ctgatggtgctgaaa

SEQ ID NO: 57589 - DNA, 15 bp, Homo sapiens
tgatggtgctgaaaa

SEQ ID NO: 57590 - DNA, 15 bp, Homo sapiens
gatggtgctgaaaat

SEQ ID NO: 57591 - DNA, 15 bp, Homo sapiens
atggtgctgaaaatc

SEQ ID NO: 57592 - DNA, 15 bp, Homo sapiens
tggtgctgaaaatct

SEQ ID NO: 57593 - DNA, 15 bp, Homo sapiens
ggtgctgaaaatctc

SEQ ID NO: 57594 - DNA, 15 bp, Homo sapiens
gtgctgaaaatctcc

SEQ ID NO: 57595 - DNA, 15 bp, Homo sapiens
tgctgaaaatctcct

SEQ ID NO: 57596 - DNA, 15 bp, Homo sapiens
gctgaaaatctcctt

SEQ ID NO: 57597 - DNA, 15 bp, Homo sapiens
ctgaaaatctccttg

SEQ ID NO: 57598 - DNA, 15 bp, Homo sapiens
tgaaaatctccttgc

SEQ ID NO: 57599 - DNA, 15 bp, Homo sapiens
gaaaatctccttgcc

SEQ ID NO: 57600 - DNA, 15 bp, Homo sapiens
aaaatctccttgccc

SEQ ID NO: 57601 - DNA, 15 bp, Homo sapiens
aaatctccttgcccg

SEQ ID NO: 57602 - DNA, 15 bp, Homo sapiens
aatctccttgcccgt

SEQ ID NO: 57603 - DNA, 15 bp, Homo sapiens
atctccttgcccgtg

SEQ ID NO: 57604 - DNA, 15 bp, Homo sapiens
tctccttgcccgtga

SEQ ID NO: 57605 - DNA, 15 bp, Homo sapiens
ctccttgcccgtgat

SEQ ID NO: 57606 - DNA, 15 bp, Homo sapiens
tccttgcccgtgatt

SEQ ID NO: 57607 - DNA, 15 bp, Homo sapiens
ccttgcccgtgattc

SEQ ID NO: 57608 - DNA, 15 bp, Homo sapiens
cttgcccgtgattct

SEQ ID NO: 57609 - DNA, 15 bp, Homo sapiens
ttgcccgtgattctc

SEQ ID NO: 57610 - DNA, 15 bp, Homo sapiens
tgcccgtgattctca

SEQ ID NO: 57611 - DNA, 15 bp, Homo sapiens
gcccgtgattctcat

SEQ ID NO: 57612 - DNA, 15 bp, Homo sapiens
cccgtgattctcatg

SEQ ID NO: 57613 - DNA, 15 bp, Homo sapiens
ccgtgattctcatgg

SEQ ID NO: 57614 - DNA, 15 bp, Homo sapiens
cgtgattctcatgga

SEQ ID NO: 57615 - DNA, 15 bp, Homo sapiens
gtgattctcatggat

SEQ ID NO: 57616 - DNA, 15 bp, Homo sapiens
tgattctcatggatg

SEQ ID NO: 57617 - DNA, 15 bp, Homo sapiens
gattctcatggatga

SEQ ID NO: 57618 - DNA, 15 bp, Homo sapiens
attctcatggatgag

SEQ ID NO: 57619 - DNA, 15 bp, Homo sapiens
ttctcatggatgaga

SEQ ID NO: 57620 - DNA, 15 bp, Homo sapiens
tctcatggatgagac

SEQ ID NO: 57621 - DNA, 15 bp, Homo sapiens
ctcatggatgagacg

SEQ ID NO: 57622 - DNA, 15 bp, Homo sapiens
tcatggatgagacgc

SEQ ID NO: 57623 - DNA, 15 bp, Homo sapiens
catggatgagacgct

SEQ ID NO: 57624 - DNA, 15 bp, Homo sapiens
atggatgagacgctc

SEQ ID NO: 57625 - DNA, 15 bp, Homo sapiens
tggatgagacgctca

SEQ ID NO: 57626 - DNA, 15 bp, Homo sapiens
ggatgagacgctcaa

SEQ ID NO: 57627 - DNA, 15 bp, Homo sapiens
gatgagacgctcaag

SEQ ID NO: 57628 - DNA, 15 bp, Homo sapiens
atgagacgctcaagt

SEQ ID NO: 57629 - DNA, 15 bp, Homo sapiens
tgagacgctcaagtt

SEQ ID NO: 57630 - DNA, 15 bp, Homo sapiens
gagacgctcaagttt

SEQ ID NO: 57631 - DNA, 15 bp, Homo sapiens
agacgctcaagtttg

SEQ ID NO: 57632 - DNA, 15 bp, Homo sapiens
gacgctcaagtttgt

SEQ ID NO: 57633 - DNA, 15 bp, Homo sapiens
acgctcaagtttgtg

SEQ ID NO: 57634 - DNA, 15 bp, Homo sapiens
cgctcaagtttgtgg

SEQ ID NO: 57635 - DNA, 15 bp, Homo sapiens
gctcaagtttgtggc

SEQ ID NO: 57636 - DNA, 15 bp, Homo sapiens
ctcaagtttgtggcc

SEQ ID NO: 57637 - DNA, 15 bp, Homo sapiens
tcaagtttgtggccc

SEQ ID NO: 57638 - DNA, 15 bp, Homo sapiens
caagtttgtggcccg

SEQ ID NO: 57639 - DNA, 15 bp, Homo sapiens
aagtttgtggcccgc

SEQ ID NO: 57640 - DNA, 15 bp, Homo sapiens
agtttgtggcccgca

SEQ ID NO: 57641 - DNA, 15 bp, Homo sapiens
gtttgtggcccgcaa

SEQ ID NO: 57642 - DNA, 15 bp, Homo sapiens
tttgtggcccgcaac

SEQ ID NO: 57643 - DNA, 15 bp, Homo sapiens
ttgtggcccgcaact

SEQ ID NO: 57644 - DNA, 15 bp, Homo sapiens
tgtggcccgcaacta

SEQ ID NO: 57645 - DNA, 15 bp, Homo sapiens
gtggcccgcaactac

SEQ ID NO: 57646 - DNA, 15 bp, Homo sapiens
tggcccgcaactacc

SEQ ID NO: 57647 - DNA, 15 bp, Homo sapiens
ggcccgcaactacct

SEQ ID NO: 57648 - DNA, 15 bp, Homo sapiens
gcccgcaactacctg

SEQ ID NO: 57649 - DNA, 15 bp, Homo sapiens
cccgcaactacctgg

SEQ ID NO: 57650 - DNA, 15 bp, Homo sapiens
ccgcaactacctgga

SEQ ID NO: 57651 - DNA, 15 bp, Homo sapiens
cgcaactacctggaa

SEQ ID NO: 57652 - DNA, 15 bp, Homo sapiens
gcaactacctggaac

SEQ ID NO: 57653 - DNA, 15 bp, Homo sapiens
caactacctggaacc

SEQ ID NO: 57654 - DNA, 15 bp, Homo sapiens
aactacctggaacct

SEQ ID NO: 57655 - DNA, 15 bp, Homo sapiens
actacctggaacctg

SEQ ID NO: 57656 - DNA, 15 bp, Homo sapiens
ctacctggaacctgg

SEQ ID NO: 57657 - DNA, 15 bp, Homo sapiens
tacctggaacctggt

SEQ ID NO: 57658 - DNA, 15 bp, Homo sapiens
acctggaacctggta

SEQ ID NO: 57659 - DNA, 15 bp, Homo sapiens
cctggaacctggtaa

SEQ ID NO: 57660 - DNA, 15 bp, Homo sapiens
ctggaacctggtaaa

SEQ ID NO: 57661 - DNA, 15 bp, Homo sapiens
tggaacctggtaaag

SEQ ID NO: 57662 - DNA, 15 bp, Homo sapiens
ggaacctggtaaaga

SEQ ID NO: 57663 - DNA, 15 bp, Homo sapiens
gaacctggtaaagag

SEQ ID NO: 57664 - DNA, 15 bp, Homo sapiens
aacctggtaaagagt

SEQ ID NO: 57665 - DNA, 15 bp, Homo sapiens
acctggtaaagagtg

SEQ ID NO: 57666 - DNA, 15 bp, Homo sapiens
cctggtaaagagtgt

SEQ ID NO: 57667 - DNA, 15 bp, Homo sapiens
ctggtaaagagtgtg

SEQ ID NO: 57668 - DNA, 15 bp, Homo sapiens
tggtaaagagtgtgt

SEQ ID NO: 57669 - DNA, 15 bp, Homo sapiens
ggtaaagagtgtgtg

SEQ ID NO: 57670 - DNA, 15 bp, Homo sapiens
gtaaagagtgtgtgc

SEQ ID NO: 57671 - DNA, 15 bp, Homo sapiens
taaagagtgtgtgca

SEQ ID NO: 57672 - DNA, 15 bp, Homo sapiens
aaagagtgtgtgcag

SEQ ID NO: 57673 - DNA, 15 bp, Homo sapiens
aagagtgtgtgcagc

SEQ ID NO: 57674 - DNA, 15 bp, Homo sapiens
agagtgtgtgcagcc

SEQ ID NO: 57675 - DNA, 15 bp, Homo sapiens
gagtgtgtgcagcct

SEQ ID NO: 57676 - DNA, 15 bp, Homo sapiens
agtgtgtgcagcctg

SEQ ID NO: 57677 - DNA, 15 bp, Homo sapiens
gtgtgtgcagcctgc

SEQ ID NO: 57678 - DNA, 15 bp, Homo sapiens
tgtgtgcagcctgcc

SEQ ID NO: 57679 - DNA, 15 bp, Homo sapiens
gtgtgcagcctgcca

SEQ ID NO: 57680 - DNA, 15 bp, Homo sapiens
tgtgcagcctgccac

SEQ ID NO: 57681 - DNA, 15 bp, Homo sapiens
gtgcagcctgccacc

SEQ ID NO: 57682 - DNA, 15 bp, Homo sapiens
tgcagcctgccacca

SEQ ID NO: 57683 - DNA, 15 bp, Homo sapiens
gcagcctgccaccaa

SEQ ID NO: 57684 - DNA, 15 bp, Homo sapiens
cagcctgccaccaaa

SEQ ID NO: 57685 - DNA, 15 bp, Homo sapiens
agcctgccaccaaat

SEQ ID NO: 57686 - DNA, 15 bp, Homo sapiens
gcctgccaccaaatc

SEQ ID NO: 57687 - DNA, 15 bp, Homo sapiens
cctgccaccaaatcc

SEQ ID NO: 57688 - DNA, 15 bp, Homo sapiens
ctgccaccaaatcct

SEQ ID NO: 57689 - DNA, 15 bp, Homo sapiens
tgccaccaaatcctg

SEQ ID NO: 57690 - DNA, 15 bp, Homo sapiens
gccaccaaatcctgc

SEQ ID NO: 57691 - DNA, 15 bp, Homo sapiens
ccaccaaatcctgct

SEQ ID NO: 57692 - DNA, 15 bp, Homo sapiens
caccaaatcctgctc

SEQ ID NO: 57693 - DNA, 15 bp, Homo sapiens
accaaatcctgctcg

SEQ ID NO: 57694 - DNA, 15 bp, Homo sapiens
ccaaatcctgctcgt

SEQ ID NO: 57695 - DNA, 15 bp, Homo sapiens
caaatcctgctcgtt

SEQ ID NO: 57696 - DNA, 15 bp, Homo sapiens
aaatcctgctcgttc

SEQ ID NO: 57697 - DNA, 15 bp, Homo sapiens
aatcctgctcgttct

SEQ ID NO: 57698 - DNA, 15 bp, Homo sapiens
atcctgctcgttctc

SEQ ID NO: 57699 - DNA, 15 bp, Homo sapiens
tcctgctcgttctcg

SEQ ID NO: 57700 - DNA, 15 bp, Homo sapiens
cctgctcgttctcgg

SEQ ID NO: 57701 - DNA, 15 bp, Homo sapiens
ctgctcgttctcggc

SEQ ID NO: 57702 - DNA, 15 bp, Homo sapiens
tgctcgttctcggca

SEQ ID NO: 57703 - DNA, 15 bp, Homo sapiens
gctcgttctcggcat

SEQ ID NO: 57704 - DNA, 15 bp, Homo sapiens
ctcgttctcggcatg

SEQ ID NO: 57705 - DNA, 15 bp, Homo sapiens
tcgttctcggcatgc

SEQ ID NO: 57706 - DNA, 15 bp, Homo sapiens
cgttctcggcatgca

SEQ ID NO: 57707 - DNA, 15 bp, Homo sapiens
gttctcggcatgcac

SEQ ID NO: 57708 - DNA, 15 bp, Homo sapiens
ttctcggcatgcacc

SEQ ID NO: 57709 - DNA, 15 bp, Homo sapiens
tctcggcatgcaccg

SEQ ID NO: 57710 - DNA, 15 bp, Homo sapiens
ctcggcatgcaccga

SEQ ID NO: 57711 - DNA, 15 bp, Homo sapiens
tcggcatgcaccgat

SEQ ID NO: 57712 - DNA, 15 bp, Homo sapiens
cggcatgcaccgatg

SEQ ID NO: 57713 - DNA, 15 bp, Homo sapiens
ggcatgcaccgatgg

SEQ ID NO: 57714 - DNA, 15 bp, Homo sapiens
gcatgcaccgatggg

SEQ ID NO: 57715 - DNA, 15 bp, Homo sapiens
catgcaccgatggga

SEQ ID NO: 57716 - DNA, 15 bp, Homo sapiens
atgcaccgatgggat

SEQ ID NO: 57717 - DNA, 15 bp, Homo sapiens
tgcaccgatgggatt

SEQ ID NO: 57718 - DNA, 15 bp, Homo sapiens
gcaccgatgggattt

SEQ ID NO: 57719 - DNA, 15 bp, Homo sapiens
caccgatgggatttc

SEQ ID NO: 57720 - DNA, 15 bp, Homo sapiens
accgatgggatttcc

SEQ ID NO: 57721 - DNA, 15 bp, Homo sapiens
ccgatgggatttcct

SEQ ID NO: 57722 - DNA, 15 bp, Homo sapiens
cgatgggatttcctg

SEQ ID NO: 57723 - DNA, 15 bp, Homo sapiens
gatgggatttcctgg

SEQ ID NO: 57724 - DNA, 15 bp, Homo sapiens
atgggatttcctggc

SEQ ID NO: 57725 - DNA, 15 bp, Homo sapiens
tgggatttcctggcc

SEQ ID NO: 57726 - DNA, 15 bp, Homo sapiens
gggatttcctggccg

SEQ ID NO: 57727 - DNA, 15 bp, Homo sapiens
ggatttcctggccgt

SEQ ID NO: 57728 - DNA, 15 bp, Homo sapiens
gatttcctggccgtt

SEQ ID NO: 57729 - DNA, 15 bp, Homo sapiens
atttcctggccgttt

SEQ ID NO: 57730 - DNA, 15 bp, Homo sapiens
tttcctggccgtttg

SEQ ID NO: 57731 - DNA, 15 bp, Homo sapiens
ttcctggccgtttgt

SEQ ID NO: 57732 - DNA, 15 bp, Homo sapiens
tcctggccgtttgtg

SEQ ID NO: 57733 - DNA, 15 bp, Homo sapiens
cctggccgtttgtgc

SEQ ID NO: 57734 - DNA, 15 bp, Homo sapiens
ctggccgtttgtgct

SEQ ID NO: 57735 - DNA, 15 bp, Homo sapiens
tggccgtttgtgctg

SEQ ID NO: 57736 - DNA, 15 bp, Homo sapiens
ggccgtttgtgctgc

SEQ ID NO: 57737 - DNA, 15 bp, Homo sapiens
gccgtttgtgctgct

SEQ ID NO: 57738 - DNA, 15 bp, Homo sapiens
ccgtttgtgctgctc

SEQ ID NO: 57739 - DNA, 15 bp, Homo sapiens
cgtttgtgctgctca

SEQ ID NO: 57740 - DNA, 15 bp, Homo sapiens
gtttgtgctgctcat

SEQ ID NO: 57741 - DNA, 15 bp, Homo sapiens
tttgtgctgctcata

SEQ ID NO: 57742 - DNA, 15 bp, Homo sapiens
ttgtgctgctcataa

SEQ ID NO: 57743 - DNA, 15 bp, Homo sapiens
tgtgctgctcataat

SEQ ID NO: 57744 - DNA, 15 bp, Homo sapiens
gtgctgctcataatg

SEQ ID NO: 57745 - DNA, 15 bp, Homo sapiens
tgctgctcataatgc

SEQ ID NO: 57746 - DNA, 15 bp, Homo sapiens
gctgctcataatgcc

SEQ ID NO: 57747 - DNA, 15 bp, Homo sapiens
ctgctcataatgccc

SEQ ID NO: 57748 - DNA, 15 bp, Homo sapiens
tgctcataatgcccc

SEQ ID NO: 57749 - DNA, 15 bp, Homo sapiens
gctcataatgcccct

SEQ ID NO: 57750 - DNA, 15 bp, Homo sapiens
ctcataatgcccctg

SEQ ID NO: 57751 - DNA, 15 bp, Homo sapiens
tcataatgcccctgg

SEQ ID NO: 57752 - DNA, 15 bp, Homo sapiens
cataatgcccctggt

SEQ ID NO: 57753 - DNA, 15 bp, Homo sapiens
ataatgcccctggtg

SEQ ID NO: 57754 - DNA, 15 bp, Homo sapiens
taatgcccctggtga

SEQ ID NO: 57755 - DNA, 15 bp, Homo sapiens
aatgcccctggtgat

SEQ ID NO: 57756 - DNA, 15 bp, Homo sapiens
atgcccctggtgatc

SEQ ID NO: 57757 - DNA, 15 bp, Homo sapiens
tgcccctggtgatct

SEQ ID NO: 57758 - DNA, 15 bp, Homo sapiens
gcccctggtgatctg

SEQ ID NO: 57759 - DNA, 15 bp, Homo sapiens
cccctggtgatctgg

SEQ ID NO: 57760 - DNA, 15 bp, Homo sapiens
ccctggtgatctggg

SEQ ID NO: 57761 - DNA, 15 bp, Homo sapiens
cctggtgatctgggt

SEQ ID NO: 57762 - DNA, 15 bp, Homo sapiens
ctggtgatctgggtc

SEQ ID NO: 57763 - DNA, 15 bp, Homo sapiens
tggtgatctgggtct

SEQ ID NO: 57764 - DNA, 15 bp, Homo sapiens
ggtgatctgggtcta

SEQ ID NO: 57765 - DNA, 15 bp, Homo sapiens
gtgatctgggtctat

SEQ ID NO: 57766 - DNA, 15 bp, Homo sapiens
tgatctgggtctata

SEQ ID NO: 57767 - DNA, 15 bp, Homo sapiens
gatctgggtctatag

SEQ ID NO: 57768 - DNA, 15 bp, Homo sapiens
atctgggtctatagc

SEQ ID NO: 57769 - DNA, 15 bp, Homo sapiens
tctgggtctatagca

SEQ ID NO: 57770 - DNA, 15 bp, Homo sapiens
ctgggtctatagcac

SEQ ID NO: 57771 - DNA, 15 bp, Homo sapiens
tgggtctatagcaca

SEQ ID NO: 57772 - DNA, 15 bp, Homo sapiens
gggtctatagcacag

SEQ ID NO: 57773 - DNA, 15 bp, Homo sapiens
ggtctatagcacaga

SEQ ID NO: 57774 - DNA, 15 bp, Homo sapiens
gtctatagcacagac

SEQ ID NO: 57775 - DNA, 15 bp, Homo sapiens
tctatagcacagaca

SEQ ID NO: 57776 - DNA, 15 bp, Homo sapiens
ctatagcacagacac

SEQ ID NO: 57777 - DNA, 15 bp, Homo sapiens
tatagcacagacact

SEQ ID NO: 57778 - DNA, 15 bp, Homo sapiens
atagcacagacacta

SEQ ID NO: 57779 - DNA, 15 bp, Homo sapiens
tagcacagacactaa

SEQ ID NO: 57780 - DNA, 15 bp, Homo sapiens
agcacagacactaac

SEQ ID NO: 57781 - DNA, 15 bp, Homo sapiens
gcacagacactaact

SEQ ID NO: 57782 - DNA, 15 bp, Homo sapiens
cacagacactaactt

SEQ ID NO: 57783 - DNA, 15 bp, Homo sapiens
acagacactaacttt

SEQ ID NO: 57784 - DNA, 15 bp, Homo sapiens
cagacactaacttta

SEQ ID NO: 57785 - DNA, 15 bp, Homo sapiens
agacactaactttag

SEQ ID NO: 57786 - DNA, 15 bp, Homo sapiens
gacactaactttagc

SEQ ID NO: 57787 - DNA, 15 bp, Homo sapiens
acactaactttagcg

SEQ ID NO: 57788 - DNA, 15 bp, Homo sapiens
cactaactttagcga

SEQ ID NO: 57789 - DNA, 15 bp, Homo sapiens
actaactttagcgat

SEQ ID NO: 57790 - DNA, 15 bp, Homo sapiens
ctaactttagcgata

SEQ ID NO: 57791 - DNA, 15 bp, Homo sapiens
taactttagcgatat

SEQ ID NO: 57792 - DNA, 15 bp, Homo sapiens
aactttagcgatatg

SEQ ID NO: 57793 - DNA, 15 bp, Homo sapiens
actttagcgatatgt

SEQ ID NO: 57794 - DNA, 15 bp, Homo sapiens
ctttagcgatatgtt

SEQ ID NO: 57795 - DNA, 15 bp, Homo sapiens
tttagcgatatgttc

SEQ ID NO: 57796 - DNA, 15 bp, Homo sapiens
ttagcgatatgttct

SEQ ID NO: 57797 - DNA, 15 bp, Homo sapiens
tagcgatatgttctg

SEQ ID NO: 57798 - DNA, 15 bp, Homo sapiens
agcgatatgttctgg

SEQ ID NO: 57799 - DNA, 15 bp, Homo sapiens
gcgatatgttctggt

SEQ ID NO: 57800 - DNA, 15 bp, Homo sapiens
cgatatgttctggtc

SEQ ID NO: 57801 - DNA, 15 bp, Homo sapiens
gatatgttctggtct

SEQ ID NO: 57802 - DNA, 15 bp, Homo sapiens
atatgttctggtctt

SEQ ID NO: 57803 - DNA, 15 bp, Homo sapiens
tatgttctggtcttg

SEQ ID NO: 57804 - DNA, 15 bp, Homo sapiens
atgttctggtcttga

SEQ ID NO: 57805 - DNA, 15 bp, Homo sapiens
tgttctggtcttgac

SEQ ID NO: 57806 - DNA, 15 bp, Homo sapiens
gttctggtcttgact

SEQ ID NO: 57807 - DNA, 15 bp, Homo sapiens
ttctggtcttgactg

SEQ ID NO: 57808 - DNA, 15 bp, Homo sapiens
tctggtcttgactga

SEQ ID NO: 57809 - DNA, 15 bp, Homo sapiens
ctggtcttgactgac

SEQ ID NO: 57810 - DNA, 15 bp, Homo sapiens
tggtcttgactgaca

SEQ ID NO: 57811 - DNA, 15 bp, Homo sapiens
ggtcttgactgacag

SEQ ID NO: 57812 - DNA, 15 bp, Homo sapiens
gtcttgactgacagt

SEQ ID NO: 57813 - DNA, 15 bp, Homo sapiens
tcttgactgacagtt

SEQ ID NO: 57814 - DNA, 15 bp, Homo sapiens
cttgactgacagttt

SEQ ID NO: 57815 - DNA, 15 bp, Homo sapiens
ttgactgacagtttt

SEQ ID NO: 57816 - DNA, 15 bp, Homo sapiens
tgactgacagttttc

SEQ ID NO: 57817 - DNA, 15 bp, Homo sapiens
gactgacagttttcc

SEQ ID NO: 57818 - DNA, 15 bp, Homo sapiens
actgacagttttcca

SEQ ID NO: 57819 - DNA, 15 bp, Homo sapiens
ctgacagttttccat

SEQ ID NO: 57820 - DNA, 15 bp, Homo sapiens
tgacagttttccata

SEQ ID NO: 57821 - DNA, 15 bp, Homo sapiens
gacagttttccataa

SEQ ID NO: 57822 - DNA, 15 bp, Homo sapiens
acagttttccataaa

SEQ ID NO: 57823 - DNA, 15 bp, Homo sapiens
cagttttccataaag

SEQ ID NO: 57824 - DNA, 15 bp, Homo sapiens
agttttccataaaga

SEQ ID NO: 57825 - DNA, 15 bp, Homo sapiens
gttttccataaagaa

SEQ ID NO: 57826 - DNA, 15 bp, Homo sapiens
ttttccataaagaag

SEQ ID NO: 57827 - DNA, 15 bp, Homo sapiens
tttccataaagaaga

SEQ ID NO: 57828 - DNA, 15 bp, Homo sapiens
ttccataaagaagat

SEQ ID NO: 57829 - DNA, 15 bp, Homo sapiens
tccataaagaagatg

SEQ ID NO: 57830 - DNA, 15 bp, Homo sapiens
ccataaagaagatgt

SEQ ID NO: 57831 - DNA, 15 bp, Homo sapiens
cataaagaagatgtt

SEQ ID NO: 57832 - DNA, 15 bp, Homo sapiens
ataaagaagatgttt

SEQ ID NO: 57833 - DNA, 15 bp, Homo sapiens
taaagaagatgttta

SEQ ID NO: 57834 - DNA, 15 bp, Homo sapiens
aaagaagatgtttaa

SEQ ID NO: 57835 - DNA, 15 bp, Homo sapiens
aagaagatgtttaac

SEQ ID NO: 57836 - DNA, 15 bp, Homo sapiens
agaagatgtttaact

SEQ ID NO: 57837 - DNA, 15 bp, Homo sapiens
gaagatgtttaactt

SEQ ID NO: 57838 - DNA, 15 bp, Homo sapiens
aagatgtttaactta

SEQ ID NO: 57839 - DNA, 15 bp, Homo sapiens
agatgtttaacttaa

SEQ ID NO: 57840 - DNA, 15 bp, Homo sapiens
gatgtttaacttaat

SEQ ID NO: 57841 - DNA, 15 bp, Homo sapiens
atgtttaacttaatc

SEQ ID NO: 57842 - DNA, 15 bp, Homo sapiens
tgtttaacttaatca

SEQ ID NO: 57843 - DNA, 15 bp, Homo sapiens
gtttaacttaatcaa

SEQ ID NO: 57844 - DNA, 15 bp, Homo sapiens
tttaacttaatcaat

SEQ ID NO: 57845 - DNA, 15 bp, Homo sapiens
ttaacttaatcaatt

SEQ ID NO: 57846 - DNA, 15 bp, Homo sapiens
taacttaatcaatta

SEQ ID NO: 57847 - DNA, 15 bp, Homo sapiens
aacttaatcaattaa

SEQ ID NO: 57848 - DNA, 15 bp, Homo sapiens
acttaatcaattaat

SEQ ID NO: 57849 - DNA, 15 bp, Homo sapiens
cttaatcaattaatt

SEQ ID NO: 57850 - DNA, 15 bp, Homo sapiens
ttaatcaattaattt

SEQ ID NO: 57851 - DNA, 15 bp, Homo sapiens
taatcaattaatttt

SEQ ID NO: 57852 - DNA, 15 bp, Homo sapiens
aatcaattaattttt

SEQ ID NO: 57853 - DNA, 15 bp, Homo sapiens
atcaattaatttttt

SEQ ID NO: 57854 - DNA, 15 bp, Homo sapiens
tcaattaattttttt

SEQ ID NO: 57855 - DNA, 15 bp, Homo sapiens
caattaattttttta

SEQ ID NO: 57856 - DNA, 15 bp, Homo sapiens
aattaatttttttat

SEQ ID NO: 57857 - DNA, 15 bp, Homo sapiens
attaatttttttatt

SEQ ID NO: 57858 - DNA, 15 bp, Homo sapiens
ttaatttttttattg

SEQ ID NO: 57859 - DNA, 15 bp, Homo sapiens
taatttttttattgt

SEQ ID NO: 57860 - DNA, 15 bp, Homo sapiens
aatttttttattgtt

SEQ ID NO: 57861 - DNA, 15 bp, Homo sapiens
atttttttattgttt

SEQ ID NO: 57862 - DNA, 15 bp, Homo sapiens
tttttttattgttta

SEQ ID NO: 57863 - DNA, 15 bp, Homo sapiens
ttttttattgtttaa

SEQ ID NO: 57864 - DNA, 15 bp, Homo sapiens
tttttattgtttaaa

SEQ ID NO: 57865 - DNA, 15 bp, Homo sapiens
ttttattgtttaaag

SEQ ID NO: 57866 - DNA, 15 bp, Homo sapiens
tttattgtttaaagc

SEQ ID NO: 57867 - DNA, 15 bp, Homo sapiens
ttattgtttaaagca

SEQ ID NO: 57868 - DNA, 15 bp, Homo sapiens
tattgtttaaagcaa

SEQ ID NO: 57869 - DNA, 15 bp, Homo sapiens
attgtttaaagcaac

SEQ ID NO: 57870 - DNA, 15 bp, Homo sapiens
ttgtttaaagcaact

SEQ ID NO: 57871 - DNA, 15 bp, Homo sapiens
tgtttaaagcaactg

SEQ ID NO: 57872 - DNA, 15 bp, Homo sapiens
gtttaaagcaactgt

SEQ ID NO: 57873 - DNA, 15 bp, Homo sapiens
tttaaagcaactgtc

SEQ ID NO: 57874 - DNA, 15 bp, Homo sapiens
ttaaagcaactgtct

SEQ ID NO: 57875 - DNA, 15 bp, Homo sapiens
taaagcaactgtcta

SEQ ID NO: 57876 - DNA, 15 bp, Homo sapiens
aaagcaactgtctat

SEQ ID NO: 57877 - DNA, 15 bp, Homo sapiens
aagcaactgtctatt

SEQ ID NO: 57878 - DNA, 15 bp, Homo sapiens
agcaactgtctattt

SEQ ID NO: 57879 - DNA, 15 bp, Homo sapiens
gcaactgtctatttc

SEQ ID NO: 57880 - DNA, 15 bp, Homo sapiens
caactgtctatttct

SEQ ID NO: 57881 - DNA, 15 bp, Homo sapiens
aactgtctatttctg

SEQ ID NO: 57882 - DNA, 15 bp, Homo sapiens
actgtctatttctgc

SEQ ID NO: 57883 - DNA, 15 bp, Homo sapiens
ctgtctatttctgct

SEQ ID NO: 57884 - DNA, 15 bp, Homo sapiens
tgtctatttctgctg

SEQ ID NO: 57885 - DNA, 15 bp, Homo sapiens
gtctatttctgctga

SEQ ID NO: 57886 - DNA, 15 bp, Homo sapiens
tctatttctgctgaa

SEQ ID NO: 57887 - DNA, 15 bp, Homo sapiens
ctatttctgctgaat

SEQ ID NO: 57888 - DNA, 15 bp, Homo sapiens
tatttctgctgaatt

SEQ ID NO: 57889 - DNA, 15 bp, Homo sapiens
atttctgctgaattt

SEQ ID NO: 57890 - DNA, 15 bp, Homo sapiens
tttctgctgaatttt

SEQ ID NO: 57891 - DNA, 15 bp, Homo sapiens
ttctgctgaattttc

SEQ ID NO: 57892 - DNA, 15 bp, Homo sapiens
tctgctgaattttca

SEQ ID NO: 57893 - DNA, 15 bp, Homo sapiens
ctgctgaattttcac

SEQ ID NO: 57894 - DNA, 15 bp, Homo sapiens
tgctgaattttcaca

SEQ ID NO: 57895 - DNA, 15 bp, Homo sapiens
gctgaattttcacat

SEQ ID NO: 57896 - DNA, 15 bp, Homo sapiens
ctgaattttcacatg

SEQ ID NO: 57897 - DNA, 15 bp, Homo sapiens
tgaattttcacatga

SEQ ID NO: 57898 - DNA, 15 bp, Homo sapiens
gaattttcacatgaa

SEQ ID NO: 57899 - DNA, 15 bp, Homo sapiens
aattttcacatgaac

SEQ ID NO: 57900 - DNA, 15 bp, Homo sapiens
attttcacatgaaca

SEQ ID NO: 57901 - DNA, 15 bp, Homo sapiens
ttttcacatgaacat

SEQ ID NO: 57902 - DNA, 15 bp, Homo sapiens
tttcacatgaacata

SEQ ID NO: 57903 - DNA, 15 bp, Homo sapiens
ttcacatgaacatac

SEQ ID NO: 57904 - DNA, 15 bp, Homo sapiens
tcacatgaacatact

SEQ ID NO: 57905 - DNA, 15 bp, Homo sapiens
cacatgaacatactg

SEQ ID NO: 57906 - DNA, 15 bp, Homo sapiens
acatgaacatactgg

SEQ ID NO: 57907 - DNA, 15 bp, Homo sapiens
catgaacatactggc

SEQ ID NO: 57908 - DNA, 15 bp, Homo sapiens
atgaacatactggct

SEQ ID NO: 57909 - DNA, 15 bp, Homo sapiens
tgaacatactggctg

SEQ ID NO: 57910 - DNA, 15 bp, Homo sapiens
gaacatactggctgg

SEQ ID NO: 57911 - DNA, 15 bp, Homo sapiens
aacatactggctggt

SEQ ID NO: 57912 - DNA, 15 bp, Homo sapiens
acatactggctggtg

SEQ ID NO: 57913 - DNA, 15 bp, Homo sapiens
catactggctggtga

SEQ ID NO: 57914 - DNA, 15 bp, Homo sapiens
atactggctggtgat

SEQ ID NO: 57915 - DNA, 15 bp, Homo sapiens
tactggctggtgatg

SEQ ID NO: 57916 - DNA, 15 bp, Homo sapiens
actggctggtgatgg

SEQ ID NO: 57917 - DNA, 15 bp, Homo sapiens
ctggctggtgatgga

SEQ ID NO: 57918 - DNA, 15 bp, Homo sapiens
tggctggtgatggag

SEQ ID NO: 57919 - DNA, 15 bp, Homo sapiens
ggctggtgatggagg

SEQ ID NO: 57920 - DNA, 15 bp, Homo sapiens
gctggtgatggaggt

SEQ ID NO: 57921 - DNA, 15 bp, Homo sapiens
ctggtgatggaggtt

SEQ ID NO: 57922 - DNA, 15 bp, Homo sapiens
tggtgatggaggttt

SEQ ID NO: 57923 - DNA, 15 bp, Homo sapiens
ggtgatggaggtttc

SEQ ID NO: 57924 - DNA, 15 bp, Homo sapiens
gtgatggaggtttca

SEQ ID NO: 57925 - DNA, 15 bp, Homo sapiens
tgatggaggtttcat

SEQ ID NO: 57926 - DNA, 15 bp, Homo sapiens
gatggaggtttcata

SEQ ID NO: 57927 - DNA, 15 bp, Homo sapiens
atggaggtttcatac

SEQ ID NO: 57928 - DNA, 15 bp, Homo sapiens
tggaggtttcatact

SEQ ID NO: 57929 - DNA, 15 bp, Homo sapiens
ggaggtttcatactc

SEQ ID NO: 57930 - DNA, 15 bp, Homo sapiens
gaggtttcatactct

SEQ ID NO: 57931 - DNA, 15 bp, Homo sapiens
aggtttcatactcta

SEQ ID NO: 57932 - DNA, 15 bp, Homo sapiens
ggtttcatactctag

SEQ ID NO: 57933 - DNA, 15 bp, Homo sapiens
gtttcatactctaga

SEQ ID NO: 57934 - DNA, 15 bp, Homo sapiens
tttcatactctagat

SEQ ID NO: 57935 - DNA, 15 bp, Homo sapiens
ttcatactctagatt

SEQ ID NO: 57936 - DNA, 15 bp, Homo sapiens
tcatactctagattt

SEQ ID NO: 57937 - DNA, 15 bp, Homo sapiens
catactctagatttt

SEQ ID NO: 57938 - DNA, 15 bp, Homo sapiens
atactctagattttg

SEQ ID NO: 57939 - DNA, 15 bp, Homo sapiens
tactctagattttgt

SEQ ID NO: 57940 - DNA, 15 bp, Homo sapiens
actctagattttgtt

SEQ ID NO: 57941 - DNA, 15 bp, Homo sapiens
ctctagattttgttt

SEQ ID NO: 57942 - DNA, 15 bp, Homo sapiens
tctagattttgtttt

SEQ ID NO: 57943 - DNA, 15 bp, Homo sapiens
ctagattttgttttg

SEQ ID NO: 57944 - DNA, 15 bp, Homo sapiens
tagattttgttttgc

SEQ ID NO: 57945 - DNA, 15 bp, Homo sapiens
agattttgttttgct

SEQ ID NO: 57946 - DNA, 15 bp, Homo sapiens
gattttgttttgctt

SEQ ID NO: 57947 - DNA, 15 bp, Homo sapiens
attttgttttgcttt

SEQ ID NO: 57948 - DNA, 15 bp, Homo sapiens
ttttgttttgctttt

SEQ ID NO: 57949 - DNA, 15 bp, Homo sapiens
tttgttttgcttttt

SEQ ID NO: 57950 - DNA, 15 bp, Homo sapiens
ttgttttgctttttc

SEQ ID NO: 57951 - DNA, 15 bp, Homo sapiens
tgttttgctttttct

SEQ ID NO: 57952 - DNA, 15 bp, Homo sapiens
gttttgctttttctg

SEQ ID NO: 57953 - DNA, 15 bp, Homo sapiens
ttttgctttttctga

SEQ ID NO: 57954 - DNA, 15 bp, Homo sapiens
tttgctttttctgac

SEQ ID NO: 57955 - DNA, 15 bp, Homo sapiens
ttgctttttctgact

SEQ ID NO: 57956 - DNA, 15 bp, Homo sapiens
tgctttttctgactc

SEQ ID NO: 57957 - DNA, 15 bp, Homo sapiens
gctttttctgactcc

SEQ ID NO: 57958 - DNA, 15 bp, Homo sapiens
ctttttctgactcca

SEQ ID NO: 57959 - DNA, 15 bp, Homo sapiens
tttttctgactccag

SEQ ID NO: 57960 - DNA, 15 bp, Homo sapiens
ttttctgactccagt

SEQ ID NO: 57961 - DNA, 15 bp, Homo sapiens
tttctgactccagtg

SEQ ID NO: 57962 - DNA, 15 bp, Homo sapiens
ttctgactccagtgg

SEQ ID NO: 57963 - DNA, 15 bp, Homo sapiens
tctgactccagtggg

SEQ ID NO: 57964 - DNA, 15 bp, Homo sapiens
ctgactccagtgggg

SEQ ID NO: 57965 - DNA, 15 bp, Homo sapiens
tgactccagtggggc

SEQ ID NO: 57966 - DNA, 15 bp, Homo sapiens
gactccagtggggca

SEQ ID NO: 57967 - DNA, 15 bp, Homo sapiens
actccagtggggcaa

SEQ ID NO: 57968 - DNA, 15 bp, Homo sapiens
ctccagtggggcaag

SEQ ID NO: 57969 - DNA, 15 bp, Homo sapiens
tccagtggggcaaga

SEQ ID NO: 57970 - DNA, 15 bp, Homo sapiens
ccagtggggcaagat

SEQ ID NO: 57971 - DNA, 15 bp, Homo sapiens
cagtggggcaagatt

SEQ ID NO: 57972 - DNA, 15 bp, Homo sapiens
agtggggcaagattt

SEQ ID NO: 57973 - DNA, 15 bp, Homo sapiens
gtggggcaagatttt

SEQ ID NO: 57974 - DNA, 15 bp, Homo sapiens
tggggcaagattttc

SEQ ID NO: 57975 - DNA, 15 bp, Homo sapiens
ggggcaagattttcc

SEQ ID NO: 57976 - DNA, 15 bp, Homo sapiens
gggcaagattttcct

SEQ ID NO: 57977 - DNA, 15 bp, Homo sapiens
ggcaagattttcctt

SEQ ID NO: 57978 - DNA, 15 bp, Homo sapiens
gcaagattttccttt

SEQ ID NO: 57979 - DNA, 15 bp, Homo sapiens
caagattttcctttt

SEQ ID NO: 57980 - DNA, 15 bp, Homo sapiens
aagattttccttttt

SEQ ID NO: 57981 - DNA, 15 bp, Homo sapiens
agattttcctttttt

SEQ ID NO: 57982 - DNA, 15 bp, Homo sapiens
gattttcctttttta

SEQ ID NO: 57983 - DNA, 15 bp, Homo sapiens
attttccttttttat

SEQ ID NO: 57984 - DNA, 15 bp, Homo sapiens
ttttccttttttata

SEQ ID NO: 57985 - DNA, 15 bp, Homo sapiens
tttccttttttatac

SEQ ID NO: 57986 - DNA, 15 bp, Homo sapiens
ttccttttttataca

SEQ ID NO: 57987 - DNA, 15 bp, Homo sapiens
tccttttttatacac

SEQ ID NO: 57988 - DNA, 15 bp, Homo sapiens
ccttttttatacaca

SEQ ID NO: 57989 - DNA, 15 bp, Homo sapiens
cttttttatacacat

SEQ ID NO: 57990 - DNA, 15 bp, Homo sapiens
tttttatacacataa

SEQ ID NO: 57991 - DNA, 15 bp, Homo sapiens
ttttatacacataat

SEQ ID NO: 57992 - DNA, 15 bp, Homo sapiens
tttatacacataatt

SEQ ID NO: 57993 - DNA, 15 bp, Homo sapiens
ttatacacataatta

SEQ ID NO: 57994 - DNA, 15 bp, Homo sapiens
tatacacataattaa

SEQ ID NO: 57995 - DNA, 15 bp, Homo sapiens
atacacataattaaa

SEQ ID NO: 57996 - DNA, 15 bp, Homo sapiens
tacacataattaaag

SEQ ID NO: 57997 - DNA, 15 bp, Homo sapiens
acacataattaaagt

SEQ ID NO: 57998 - DNA, 15 bp, Homo sapiens
cacataattaaagtg

SEQ ID NO: 57999 - DNA, 15 bp, Homo sapiens
acataattaaagtgt

SEQ ID NO: 58000 - DNA, 15 bp, Homo sapiens
cataattaaagtgtc

SEQ ID NO: 58001 - DNA, 15 bp, Homo sapiens
ataattaaagtgtcc

SEQ ID NO: 58002 - DNA, 15 bp, Homo sapiens
taattaaagtgtcca

SEQ ID NO: 58003 - DNA, 15 bp, Homo sapiens
aattaaagtgtccat

SEQ ID NO: 58004 - DNA, 15 bp, Homo sapiens
attaaagtgtccatt

SEQ ID NO: 58005 - DNA, 15 bp, Homo sapiens
ttaaagtgtccattg

SEQ ID NO: 58006 - DNA, 15 bp, Homo sapiens
taaagtgtccattga

SEQ ID NO: 58007 - DNA, 15 bp, Homo sapiens
aaagtgtccattgac

SEQ ID NO: 58008 - DNA, 15 bp, Homo sapiens
aagtgtccattgaca

SEQ ID NO: 58009 - DNA, 15 bp, Homo sapiens
agtgtccattgacat

SEQ ID NO: 58010 - DNA, 15 bp, Homo sapiens
gtgtccattgacatg

SEQ ID NO: 58011 - DNA, 15 bp, Homo sapiens
tgtccattgacatgt

SEQ ID NO: 58012 - DNA, 15 bp, Homo sapiens
gtccattgacatgta

SEQ ID NO: 58013 - DNA, 15 bp, Homo sapiens
tccattgacatgtac

SEQ ID NO: 58014 - DNA, 15 bp, Homo sapiens
ccattgacatgtaca

SEQ ID NO: 58015 - DNA, 15 bp, Homo sapiens
cattgacatgtacag

SEQ ID NO: 58016 - DNA, 15 bp, Homo sapiens
attgacatgtacaga

SEQ ID NO: 58017 - DNA, 15 bp, Homo sapiens
ttgacatgtacagag

SEQ ID NO: 58018 - DNA, 15 bp, Homo sapiens
tgacatgtacagaga

SEQ ID NO: 58019 - DNA, 15 bp, Homo sapiens
gacatgtacagagaa

SEQ ID NO: 58020 - DNA, 15 bp, Homo sapiens
acatgtacagagaac

SEQ ID NO: 58021 - DNA, 15 bp, Homo sapiens
catgtacagagaact

SEQ ID NO: 58022 - DNA, 15 bp, Homo sapiens
atgtacagagaacta

SEQ ID NO: 58023 - DNA, 15 bp, Homo sapiens
tgtacagagaactaa

SEQ ID NO: 58024 - DNA, 15 bp, Homo sapiens
gtacagagaactaac

SEQ ID NO: 58025 - DNA, 15 bp, Homo sapiens
tacagagaactaaca

SEQ ID NO: 58026 - DNA, 15 bp, Homo sapiens
acagagaactaacac

SEQ ID NO: 58027 - DNA, 15 bp, Homo sapiens
cagagaactaacact

SEQ ID NO: 58028 - DNA, 15 bp, Homo sapiens
agagaactaacacta

SEQ ID NO: 58029 - DNA, 15 bp, Homo sapiens
gagaactaacactat

SEQ ID NO: 58030 - DNA, 15 bp, Homo sapiens
agaactaacactatt

SEQ ID NO: 58031 - DNA, 15 bp, Homo sapiens
gaactaacactattt

SEQ ID NO: 58032 - DNA, 15 bp, Homo sapiens
aactaacactatttt

SEQ ID NO: 58033 - DNA, 15 bp, Homo sapiens
actaacactatttta

SEQ ID NO: 58034 - DNA, 15 bp, Homo sapiens
ctaacactattttat

SEQ ID NO: 58035 - DNA, 15 bp, Homo sapiens
taacactattttatg

SEQ ID NO: 58036 - DNA, 15 bp, Homo sapiens
aacactattttatgc

SEQ ID NO: 58037 - DNA, 15 bp, Homo sapiens
acactattttatgca

SEQ ID NO: 58038 - DNA, 15 bp, Homo sapiens
cactattttatgcaa

SEQ ID NO: 58039 - DNA, 15 bp, Homo sapiens
actattttatgcaaa

SEQ ID NO: 58040 - DNA, 15 bp, Homo sapiens
ctattttatgcaaat

SEQ ID NO: 58041 - DNA, 15 bp, Homo sapiens
tattttatgcaaata

SEQ ID NO: 58042 - DNA, 15 bp, Homo sapiens
attttatgcaaatat

SEQ ID NO: 58043 - DNA, 15 bp, Homo sapiens
ttttatgcaaatatt

SEQ ID NO: 58044 - DNA, 15 bp, Homo sapiens
tttatgcaaatattt

SEQ ID NO: 58045 - DNA, 15 bp, Homo sapiens
ttatgcaaatatttt

SEQ ID NO: 58046 - DNA, 15 bp, Homo sapiens
tatgcaaatattttt

SEQ ID NO: 58047 - DNA, 15 bp, Homo sapiens
atgcaaatatttttt

SEQ ID NO: 58048 - DNA, 15 bp, Homo sapiens
tgcaaatattttttt

SEQ ID NO: 58049 - DNA, 15 bp, Homo sapiens
gcaaatatttttttg

SEQ ID NO: 58050 - DNA, 15 bp, Homo sapiens
caaatatttttttgt

SEQ ID NO: 58051 - DNA, 15 bp, Homo sapiens
aaatatttttttgta

SEQ ID NO: 58052 - DNA, 15 bp, Homo sapiens
aatatttttttgtag

SEQ ID NO: 58053 - DNA, 15 bp, Homo sapiens
atatttttttgtaga

SEQ ID NO: 58054 - DNA, 15 bp, Homo sapiens
tatttttttgtagat

SEQ ID NO: 58055 - DNA, 15 bp, Homo sapiens
atttttttgtagatg

SEQ ID NO: 58056 - DNA, 15 bp, Homo sapiens
tttttttgtagatga

SEQ ID NO: 58057 - DNA, 15 bp, Homo sapiens
ttttttgtagatgaa

SEQ ID NO: 58058 - DNA, 15 bp, Homo sapiens
tttttgtagatgaaa

SEQ ID NO: 58059 - DNA, 15 bp, Homo sapiens
ttttgtagatgaaaa

SEQ ID NO: 58060 - DNA, 15 bp, Homo sapiens
tttgtagatgaaaaa

SEQ ID NO: 58061 - DNA, 15 bp, Homo sapiens
ttgtagatgaaaaag

SEQ ID NO: 58062 - DNA, 15 bp, Homo sapiens
tgtagatgaaaaagc

SEQ ID NO: 58063 - DNA, 15 bp, Homo sapiens
gtagatgaaaaagca

SEQ ID NO: 58064 - DNA, 15 bp, Homo sapiens
tagatgaaaaagcat

SEQ ID NO: 58065 - DNA, 15 bp, Homo sapiens
agatgaaaaagcatg

SEQ ID NO: 58066 - DNA, 15 bp, Homo sapiens
gatgaaaaagcatgt

SEQ ID NO: 58067 - DNA, 15 bp, Homo sapiens
atgaaaaagcatgta

SEQ ID NO: 58068 - DNA, 15 bp, Homo sapiens
tgaaaaagcatgtac

SEQ ID NO: 58069 - DNA, 15 bp, Homo sapiens
gaaaaagcatgtaca

SEQ ID NO: 58070 - DNA, 15 bp, Homo sapiens
aaaaagcatgtacag

SEQ ID NO: 58071 - DNA, 15 bp, Homo sapiens
aaaagcatgtacagt

SEQ ID NO: 58072 - DNA, 15 bp, Homo sapiens
aaagcatgtacagtg

SEQ ID NO: 58073 - DNA, 15 bp, Homo sapiens
aagcatgtacagtgt

SEQ ID NO: 58074 - DNA, 15 bp, Homo sapiens
agcatgtacagtgtt

SEQ ID NO: 58075 - DNA, 15 bp, Homo sapiens
gcatgtacagtgttc

SEQ ID NO: 58076 - DNA, 15 bp, Homo sapiens
catgtacagtgttct

SEQ ID NO: 58077 - DNA, 15 bp, Homo sapiens
atgtacagtgttctg

SEQ ID NO: 58078 - DNA, 15 bp, Homo sapiens
tgtacagtgttctgt

SEQ ID NO: 58079 - DNA, 15 bp, Homo sapiens
gtacagtgttctgtt

SEQ ID NO: 58080 - DNA, 15 bp, Homo sapiens
tacagtgttctgttt

SEQ ID NO: 58081 - DNA, 15 bp, Homo sapiens
acagtgttctgttta

SEQ ID NO: 58082 - DNA, 15 bp, Homo sapiens
cagtgttctgtttaa

SEQ ID NO: 58083 - DNA, 15 bp, Homo sapiens
agtgttctgtttaat

SEQ ID NO: 58084 - DNA, 15 bp, Homo sapiens
gtgttctgtttaata

SEQ ID NO: 58085 - DNA, 15 bp, Homo sapiens
tgttctgtttaatac

SEQ ID NO: 58086 - DNA, 15 bp, Homo sapiens
gttctgtttaatact

SEQ ID NO: 58087 - DNA, 15 bp, Homo sapiens
ttctgtttaatactc

SEQ ID NO: 58088 - DNA, 15 bp, Homo sapiens
tctgtttaatactca

SEQ ID NO: 58089 - DNA, 15 bp, Homo sapiens
ctgtttaatactcat

SEQ ID NO: 58090 - DNA, 15 bp, Homo sapiens
tgtttaatactcatc

SEQ ID NO: 58091 - DNA, 15 bp, Homo sapiens
gtttaatactcatcc

SEQ ID NO: 58092 - DNA, 15 bp, Homo sapiens
tttaatactcatcct

SEQ ID NO: 58093 - DNA, 15 bp, Homo sapiens
ttaatactcatcctt

SEQ ID NO: 58094 - DNA, 15 bp, Homo sapiens
taatactcatccttg

SEQ ID NO: 58095 - DNA, 15 bp, Homo sapiens
aatactcatccttgt

SEQ ID NO: 58096 - DNA, 15 bp, Homo sapiens
atactcatccttgta

SEQ ID NO: 58097 - DNA, 15 bp, Homo sapiens
tactcatccttgtat

SEQ ID NO: 58098 - DNA, 15 bp, Homo sapiens
actcatccttgtata

SEQ ID NO: 58099 - DNA, 15 bp, Homo sapiens
ctcatccttgtataa

SEQ ID NO: 58100 - DNA, 15 bp, Homo sapiens
tcatccttgtataaa

SEQ ID NO: 58101 - DNA, 15 bp, Homo sapiens
catccttgtataaaa

SEQ ID NO: 58102 - DNA, 15 bp, Homo sapiens
atccttgtataaaaa

SEQ ID NO: 58103 - DNA, 15 bp, Homo sapiens
tccttgtataaaaaa

SEQ ID NO: 58104 - DNA, 15 bp, Homo sapiens
ccttgtataaaaaaa

SEQ ID NO: 58105 - DNA, 15 bp, Homo sapiens
cttgtataaaaaaaa

SEQ ID NO: 58106 - DNA, 15 bp, Homo sapiens
ttgtataaaaaaaat

SEQ ID NO: 58107 - DNA, 15 bp, Homo sapiens
tgtataaaaaaaata

SEQ ID NO: 58108 - DNA, 15 bp, Homo sapiens
gtataaaaaaaatag

SEQ ID NO: 58109 - DNA, 15 bp, Homo sapiens
tataaaaaaaatagt

SEQ ID NO: 58110 - DNA, 15 bp, Homo sapiens
ataaaaaaaatagtt

SEQ ID NO: 58111 - DNA, 15 bp, Homo sapiens
taaaaaaaatagttg

SEQ ID NO: 58112 - DNA, 15 bp, Homo sapiens
aaaaaaaatagttga

SEQ ID NO: 58113 - DNA, 15 bp, Homo sapiens
aaaaaaatagttgag

SEQ ID NO: 58114 - DNA, 15 bp, Homo sapiens
aaaaaatagttgagc

SEQ ID NO: 58115 - DNA, 15 bp, Homo sapiens
aaaaatagttgagcc

SEQ ID NO: 58116 - DNA, 15 bp, Homo sapiens
aaaatagttgagcca

SEQ ID NO: 58117 - DNA, 15 bp, Homo sapiens
aaatagttgagccag

SEQ ID NO: 58118 - DNA, 15 bp, Homo sapiens
aatagttgagccagc

SEQ ID NO: 58119 - DNA, 15 bp, Homo sapiens
atagttgagccagca

SEQ ID NO: 58120 - DNA, 15 bp, Homo sapiens
tagttgagccagcag

SEQ ID NO: 58121 - DNA, 15 bp, Homo sapiens
agttgagccagcaga

SEQ ID NO: 58122 - DNA, 15 bp, Homo sapiens
gttgagccagcagac

SEQ ID NO: 58123 - DNA, 15 bp, Homo sapiens
ttgagccagcagaca

SEQ ID NO: 58124 - DNA, 15 bp, Homo sapiens
tgagccagcagacat

SEQ ID NO: 58125 - DNA, 15 bp, Homo sapiens
gagccagcagacatt

SEQ ID NO: 58126 - DNA, 15 bp, Homo sapiens
agccagcagacattg

SEQ ID NO: 58127 - DNA, 15 bp, Homo sapiens
gccagcagacattgt

SEQ ID NO: 58128 - DNA, 15 bp, Homo sapiens
ccagcagacattgtc

SEQ ID NO: 58129 - DNA, 15 bp, Homo sapiens
cagcagacattgtca

SEQ ID NO: 58130 - DNA, 15 bp, Homo sapiens
agcagacattgtcag

SEQ ID NO: 58131 - DNA, 15 bp, Homo sapiens
gcagacattgtcagc

SEQ ID NO: 58132 - DNA, 15 bp, Homo sapiens
cagacattgtcagca

SEQ ID NO: 58133 - DNA, 15 bp, Homo sapiens
agacattgtcagcaa

SEQ ID NO: 58134 - DNA, 15 bp, Homo sapiens
gacattgtcagcaaa

SEQ ID NO: 58135 - DNA, 15 bp, Homo sapiens
acattgtcagcaaat

SEQ ID NO: 58136 - DNA, 15 bp, Homo sapiens
cattgtcagcaaatt

SEQ ID NO: 58137 - DNA, 15 bp, Homo sapiens
attgtcagcaaatta

SEQ ID NO: 58138 - DNA, 15 bp, Homo sapiens
ttgtcagcaaattaa

SEQ ID NO: 58139 - DNA, 15 bp, Homo sapiens
tgtcagcaaattaat

SEQ ID NO: 58140 - DNA, 15 bp, Homo sapiens
gtcagcaaattaatt

SEQ ID NO: 58141 - DNA, 15 bp, Homo sapiens
tcagcaaattaattg

SEQ ID NO: 58142 - DNA, 15 bp, Homo sapiens
cagcaaattaattgg

SEQ ID NO: 58143 - DNA, 15 bp, Homo sapiens
agcaaattaattggc

SEQ ID NO: 58144 - DNA, 15 bp, Homo sapiens
gcaaattaattggca

SEQ ID NO: 58145 - DNA, 15 bp, Homo sapiens
caaattaattggcag

SEQ ID NO: 58146 - DNA, 15 bp, Homo sapiens
aaattaattggcagc

SEQ ID NO: 58147 - DNA, 15 bp, Homo sapiens
aattaattggcagca

SEQ ID NO: 58148 - DNA, 15 bp, Homo sapiens
attaattggcagcag

SEQ ID NO: 58149 - DNA, 15 bp, Homo sapiens
ttaattggcagcaga

SEQ ID NO: 58150 - DNA, 15 bp, Homo sapiens
taattggcagcagat

SEQ ID NO: 58151 - DNA, 15 bp, Homo sapiens
aattggcagcagatt

SEQ ID NO: 58152 - DNA, 15 bp, Homo sapiens
attggcagcagattt

SEQ ID NO: 58153 - DNA, 15 bp, Homo sapiens
ttggcagcagatttt

SEQ ID NO: 58154 - DNA, 15 bp, Homo sapiens
tggcagcagatttta

SEQ ID NO: 58155 - DNA, 15 bp, Homo sapiens
ggcagcagattttag

SEQ ID NO: 58156 - DNA, 15 bp, Homo sapiens
gcagcagattttagg

SEQ ID NO: 58157 - DNA, 15 bp, Homo sapiens
cagcagattttagga

SEQ ID NO: 58158 - DNA, 15 bp, Homo sapiens
agcagattttaggaa

SEQ ID NO: 58159 - DNA, 15 bp, Homo sapiens
gcagattttaggaaa

SEQ ID NO: 58160 - DNA, 15 bp, Homo sapiens
cagattttaggaaat

SEQ ID NO: 58161 - DNA, 15 bp, Homo sapiens
agattttaggaaatg

SEQ ID NO: 58162 - DNA, 15 bp, Homo sapiens
gattttaggaaatga

SEQ ID NO: 58163 - DNA, 15 bp, Homo sapiens
attttaggaaatgaa

SEQ ID NO: 58164 - DNA, 15 bp, Homo sapiens
ttttaggaaatgaat

SEQ ID NO: 58165 - DNA, 15 bp, Homo sapiens
tttaggaaatgaatg

SEQ ID NO: 58166 - DNA, 15 bp, Homo sapiens
ttaggaaatgaatgt

SEQ ID NO: 58167 - DNA, 15 bp, Homo sapiens
taggaaatgaatgtg

SEQ ID NO: 58168 - DNA, 15 bp, Homo sapiens
aggaaatgaatgtgt

SEQ ID NO: 58169 - DNA, 15 bp, Homo sapiens
ggaaatgaatgtgtg

SEQ ID NO: 58170 - DNA, 15 bp, Homo sapiens
gaaatgaatgtgtgt

SEQ ID NO: 58171 - DNA, 15 bp, Homo sapiens
aaatgaatgtgtgtg

SEQ ID NO: 58172 - DNA, 15 bp, Homo sapiens
aatgaatgtgtgtgg

SEQ ID NO: 58173 - DNA, 15 bp, Homo sapiens
atgaatgtgtgtggt

SEQ ID NO: 58174 - DNA, 15 bp, Homo sapiens
tgaatgtgtgtggtt

SEQ ID NO: 58175 - DNA, 15 bp, Homo sapiens
gaatgtgtgtggttt

SEQ ID NO: 58176 - DNA, 15 bp, Homo sapiens
aatgtgtgtggtttt

SEQ ID NO: 58177 - DNA, 15 bp, Homo sapiens
atgtgtgtggttttt

SEQ ID NO: 58178 - DNA, 15 bp, Homo sapiens
tgtgtgtggtttttt

SEQ ID NO: 58179 - DNA, 15 bp, Homo sapiens
gtgtgtggttttttt

SEQ ID NO: 58180 - DNA, 15 bp, Homo sapiens
tgtgtggtttttttt

SEQ ID NO: 58181 - DNA, 15 bp, Homo sapiens
gtgtggttttttttc

SEQ ID NO: 58182 - DNA, 15 bp, Homo sapiens
tgtggttttttttct

SEQ ID NO: 58183 - DNA, 15 bp, Homo sapiens
gtggttttttttcta

SEQ ID NO: 58184 - DNA, 15 bp, Homo sapiens
tggttttttttctaa

SEQ ID NO: 58185 - DNA, 15 bp, Homo sapiens
ggttttttttctaaa

SEQ ID NO: 58186 - DNA, 15 bp, Homo sapiens
gttttttttctaaaa

SEQ ID NO: 58187 - DNA, 15 bp, Homo sapiens
ttttttttctaaaac

SEQ ID NO: 58188 - DNA, 15 bp, Homo sapiens
tttttttctaaaact

SEQ ID NO: 58189 - DNA, 15 bp, Homo sapiens
ttttttctaaaacta

SEQ ID NO: 58190 - DNA, 15 bp, Homo sapiens
tttttctaaaactaa

SEQ ID NO: 58191 - DNA, 15 bp, Homo sapiens
ttttctaaaactaaa

SEQ ID NO: 58192 - DNA, 15 bp, Homo sapiens
tttctaaaactaaat

SEQ ID NO: 58193 - DNA, 15 bp, Homo sapiens
ttctaaaactaaata

SEQ ID NO: 58194 - DNA, 15 bp, Homo sapiens
tctaaaactaaatag

SEQ ID NO: 58195 - DNA, 15 bp, Homo sapiens
ctaaaactaaatagc

SEQ ID NO: 58196 - DNA, 15 bp, Homo sapiens
taaaactaaatagca

SEQ ID NO: 58197 - DNA, 15 bp, Homo sapiens
aaaactaaatagcat

SEQ ID NO: 58198 - DNA, 15 bp, Homo sapiens
aaactaaatagcatg

SEQ ID NO: 58199 - DNA, 15 bp, Homo sapiens
aactaaatagcatgt

SEQ ID NO: 58200 - DNA, 15 bp, Homo sapiens
actaaatagcatgta

SEQ ID NO: 58201 - DNA, 15 bp, Homo sapiens
ctaaatagcatgtat

SEQ ID NO: 58202 - DNA, 15 bp, Homo sapiens
taaatagcatgtatt

SEQ ID NO: 58203 - DNA, 15 bp, Homo sapiens
aaatagcatgtattg

SEQ ID NO: 58204 - DNA, 15 bp, Homo sapiens
aatagcatgtattgt

SEQ ID NO: 58205 - DNA, 15 bp, Homo sapiens
atagcatgtattgtg

SEQ ID NO: 58206 - DNA, 15 bp, Homo sapiens
tagcatgtattgtgt

SEQ ID NO: 58207 - DNA, 15 bp, Homo sapiens
agcatgtattgtgtc

SEQ ID NO: 58208 - DNA, 15 bp, Homo sapiens
gcatgtattgtgtct

SEQ ID NO: 58209 - DNA, 15 bp, Homo sapiens
catgtattgtgtctt

SEQ ID NO: 58210 - DNA, 15 bp, Homo sapiens
atgtattgtgtcttt

SEQ ID NO: 58211 - DNA, 15 bp, Homo sapiens
tgtattgtgtctttt

SEQ ID NO: 58212 - DNA, 15 bp, Homo sapiens
gtattgtgtcttttg

SEQ ID NO: 58213 - DNA, 15 bp, Homo sapiens
tattgtgtcttttgc

SEQ ID NO: 58214 - DNA, 15 bp, Homo sapiens
attgtgtcttttgca

SEQ ID NO: 58215 - DNA, 15 bp, Homo sapiens
ttgtgtcttttgcat

SEQ ID NO: 58216 - DNA, 15 bp, Homo sapiens
tgtgtcttttgcatg

SEQ ID NO: 58217 - DNA, 15 bp, Homo sapiens
gtgtcttttgcatga

SEQ ID NO: 58218 - DNA, 15 bp, Homo sapiens
tgtcttttgcatgat

SEQ ID NO: 58219 - DNA, 15 bp, Homo sapiens
gtcttttgcatgatg

SEQ ID NO: 58220 - DNA, 15 bp, Homo sapiens
tcttttgcatgatga

SEQ ID NO: 58221 - DNA, 15 bp, Homo sapiens
cttttgcatgatgat

SEQ ID NO: 58222 - DNA, 15 bp, Homo sapiens
ttttgcatgatgatc

SEQ ID NO: 58223 - DNA, 15 bp, Homo sapiens
tttgcatgatgatcc

SEQ ID NO: 58224 - DNA, 15 bp, Homo sapiens
ttgcatgatgatccg

SEQ ID NO: 58225 - DNA, 15 bp, Homo sapiens
tgcatgatgatccgg

SEQ ID NO: 58226 - DNA, 15 bp, Homo sapiens
gcatgatgatccgga

SEQ ID NO: 58227 - DNA, 15 bp, Homo sapiens
catgatgatccggat

SEQ ID NO: 58228 - DNA, 15 bp, Homo sapiens
atgatgatccggatt

SEQ ID NO: 58229 - DNA, 15 bp, Homo sapiens
tgatgatccggattt

SEQ ID NO: 58230 - DNA, 15 bp, Homo sapiens
gatgatccggattta

SEQ ID NO: 58231 - DNA, 15 bp, Homo sapiens
atgatccggatttaa

SEQ ID NO: 58232 - DNA, 15 bp, Homo sapiens
tgatccggatttaat

SEQ ID NO: 58233 - DNA, 15 bp, Homo sapiens
gatccggatttaatt

SEQ ID NO: 58234 - DNA, 15 bp, Homo sapiens
atccggatttaattt

SEQ ID NO: 58235 - DNA, 15 bp, Homo sapiens
tccggatttaatttg

SEQ ID NO: 58236 - DNA, 15 bp, Homo sapiens
ccggatttaatttga

SEQ ID NO: 58237 - DNA, 15 bp, Homo sapiens
cggatttaatttgat

SEQ ID NO: 58238 - DNA, 15 bp, Homo sapiens
ggatttaatttgata

SEQ ID NO: 58239 - DNA, 15 bp, Homo sapiens
gatttaatttgatat

SEQ ID NO: 58240 - DNA, 15 bp, Homo sapiens
atttaatttgatatc

SEQ ID NO: 58241 - DNA, 15 bp, Homo sapiens
tttaatttgatatca

SEQ ID NO: 58242 - DNA, 15 bp, Homo sapiens
ttaatttgatatcac

SEQ ID NO: 58243 - DNA, 15 bp, Homo sapiens
taatttgatatcaca

SEQ ID NO: 58244 - DNA, 15 bp, Homo sapiens
aatttgatatcacag

SEQ ID NO: 58245 - DNA, 15 bp, Homo sapiens
atttgatatcacagt

SEQ ID NO: 58246 - DNA, 15 bp, Homo sapiens
tttgatatcacagtc

SEQ ID NO: 58247 - DNA, 15 bp, Homo sapiens
ttgatatcacagtct

SEQ ID NO: 58248 - DNA, 15 bp, Homo sapiens
tgatatcacagtcta

SEQ ID NO: 58249 - DNA, 15 bp, Homo sapiens
gatatcacagtctaa

SEQ ID NO: 58250 - DNA, 15 bp, Homo sapiens
atatcacagtctaat

SEQ ID NO: 58251 - DNA, 15 bp, Homo sapiens
tatcacagtctaatt

SEQ ID NO: 58252 - DNA, 15 bp, Homo sapiens
atcacagtctaattt

SEQ ID NO: 58253 - DNA, 15 bp, Homo sapiens
tcacagtctaatttt

SEQ ID NO: 58254 - DNA, 15 bp, Homo sapiens
cacagtctaattttt

SEQ ID NO: 58255 - DNA, 15 bp, Homo sapiens
acagtctaattttta

SEQ ID NO: 58256 - DNA, 15 bp, Homo sapiens
cagtctaatttttat

SEQ ID NO: 58257 - DNA, 15 bp, Homo sapiens
agtctaatttttatt

SEQ ID NO: 58258 - DNA, 15 bp, Homo sapiens
gtctaatttttattc

SEQ ID NO: 58259 - DNA, 15 bp, Homo sapiens
tctaatttttattca

SEQ ID NO: 58260 - DNA, 15 bp, Homo sapiens
ctaatttttattcat

SEQ ID NO: 58261 - DNA, 15 bp, Homo sapiens
taatttttattcata

SEQ ID NO: 58262 - DNA, 15 bp, Homo sapiens
aatttttattcataa

SEQ ID NO: 58263 - DNA, 15 bp, Homo sapiens
atttttattcataag

SEQ ID NO: 58264 - DNA, 15 bp, Homo sapiens
tttttattcataagc

SEQ ID NO: 58265 - DNA, 15 bp, Homo sapiens
ttttattcataagcc

SEQ ID NO: 58266 - DNA, 15 bp, Homo sapiens
tttattcataagcca

SEQ ID NO: 58267 - DNA, 15 bp, Homo sapiens
ttattcataagccaa

SEQ ID NO: 58268 - DNA, 15 bp, Homo sapiens
tattcataagccaat

SEQ ID NO: 58269 - DNA, 15 bp, Homo sapiens
attcataagccaatt

SEQ ID NO: 58270 - DNA, 15 bp, Homo sapiens
ttcataagccaattt

SEQ ID NO: 58271 - DNA, 15 bp, Homo sapiens
tcataagccaatttt

SEQ ID NO: 58272 - DNA, 15 bp, Homo sapiens
cataagccaattttt

SEQ ID NO: 58273 - DNA, 15 bp, Homo sapiens
ataagccaatttttc

SEQ ID NO: 58274 - DNA, 15 bp, Homo sapiens
taagccaatttttct

SEQ ID NO: 58275 - DNA, 15 bp, Homo sapiens
aagccaatttttctg

SEQ ID NO: 58276 - DNA, 15 bp, Homo sapiens
agccaatttttctgc

SEQ ID NO: 58277 - DNA, 15 bp, Homo sapiens
gccaatttttctgca

SEQ ID NO: 58278 - DNA, 15 bp, Homo sapiens
ccaatttttctgcac

SEQ ID NO: 58279 - DNA, 15 bp, Homo sapiens
caatttttctgcact

SEQ ID NO: 58280 - DNA, 15 bp, Homo sapiens
aatttttctgcactg

SEQ ID NO: 58281 - DNA, 15 bp, Homo sapiens
atttttctgcactga

SEQ ID NO: 58282 - DNA, 15 bp, Homo sapiens
tttttctgcactgag

SEQ ID NO: 58283 - DNA, 15 bp, Homo sapiens
ttttctgcactgagc

SEQ ID NO: 58284 - DNA, 15 bp, Homo sapiens
tttctgcactgagca

SEQ ID NO: 58285 - DNA, 15 bp, Homo sapiens
ttctgcactgagcag

SEQ ID NO: 58286 - DNA, 15 bp, Homo sapiens
tctgcactgagcaga

SEQ ID NO: 58287 - DNA, 15 bp, Homo sapiens
ctgcactgagcagag

SEQ ID NO: 58288 - DNA, 15 bp, Homo sapiens
tgcactgagcagagt

SEQ ID NO: 58289 - DNA, 15 bp, Homo sapiens
gcactgagcagagtc

SEQ ID NO: 58290 - DNA, 15 bp, Homo sapiens
cactgagcagagtct

SEQ ID NO: 58291 - DNA, 15 bp, Homo sapiens
actgagcagagtctt

SEQ ID NO: 58292 - DNA, 15 bp, Homo sapiens
ctgagcagagtcttg

SEQ ID NO: 58293 - DNA, 15 bp, Homo sapiens
tgagcagagtcttgc

SEQ ID NO: 58294 - DNA, 15 bp, Homo sapiens
gagcagagtcttgct

SEQ ID NO: 58295 - DNA, 15 bp, Homo sapiens
agcagagtcttgcta

SEQ ID NO: 58296 - DNA, 15 bp, Homo sapiens
gcagagtcttgctac

SEQ ID NO: 58297 - DNA, 15 bp, Homo sapiens
cagagtcttgctacc

SEQ ID NO: 58298 - DNA, 15 bp, Homo sapiens
agagtcttgctacct

SEQ ID NO: 58299 - DNA, 15 bp, Homo sapiens
gagtcttgctacctc

SEQ ID NO: 58300 - DNA, 15 bp, Homo sapiens
agtcttgctacctca

SEQ ID NO: 58301 - DNA, 15 bp, Homo sapiens
gtcttgctacctcag

SEQ ID NO: 58302 - DNA, 15 bp, Homo sapiens
tcttgctacctcagt

SEQ ID NO: 58303 - DNA, 15 bp, Homo sapiens
cttgctacctcagtc

SEQ ID NO: 58304 - DNA, 15 bp, Homo sapiens
ttgctacctcagtca

SEQ ID NO: 58305 - DNA, 15 bp, Homo sapiens
tgctacctcagtcag

SEQ ID NO: 58306 - DNA, 15 bp, Homo sapiens
gctacctcagtcagt

SEQ ID NO: 58307 - DNA, 15 bp, Homo sapiens
ctacctcagtcagta

SEQ ID NO: 58308 - DNA, 15 bp, Homo sapiens
tacctcagtcagtat

SEQ ID NO: 58309 - DNA, 15 bp, Homo sapiens
acctcagtcagtatt

SEQ ID NO: 58310 - DNA, 15 bp, Homo sapiens
cctcagtcagtattg

SEQ ID NO: 58311 - DNA, 15 bp, Homo sapiens
ctcagtcagtattgt

SEQ ID NO: 58312 - DNA, 15 bp, Homo sapiens
tcagtcagtattgtt

SEQ ID NO: 58313 - DNA, 15 bp, Homo sapiens
cagtcagtattgttt

SEQ ID NO: 58314 - DNA, 15 bp, Homo sapiens
agtcagtattgtttt

SEQ ID NO: 58315 - DNA, 15 bp, Homo sapiens
gtcagtattgttttg

SEQ ID NO: 58316 - DNA, 15 bp, Homo sapiens
tcagtattgttttgg

SEQ ID NO: 58317 - DNA, 15 bp, Homo sapiens
cagtattgttttggt

SEQ ID NO: 58318 - DNA, 15 bp, Homo sapiens
agtattgttttggtt

SEQ ID NO: 58319 - DNA, 15 bp, Homo sapiens
gtattgttttggttt

SEQ ID NO: 58320 - DNA, 15 bp, Homo sapiens
tattgttttggtttg

SEQ ID NO: 58321 - DNA, 15 bp, Homo sapiens
attgttttggtttgc

SEQ ID NO: 58322 - DNA, 15 bp, Homo sapiens
ttgttttggtttgct

SEQ ID NO: 58323 - DNA, 15 bp, Homo sapiens
tgttttggtttgcta

SEQ ID NO: 58324 - DNA, 15 bp, Homo sapiens
gttttggtttgctac

SEQ ID NO: 58325 - DNA, 15 bp, Homo sapiens
ttttggtttgctact

SEQ ID NO: 58326 - DNA, 15 bp, Homo sapiens
tttggtttgctactt

SEQ ID NO: 58327 - DNA, 15 bp, Homo sapiens
ttggtttgctacttc

SEQ ID NO: 58328 - DNA, 15 bp, Homo sapiens
tggtttgctacttcc

SEQ ID NO: 58329 - DNA, 15 bp, Homo sapiens
ggtttgctacttccc

SEQ ID NO: 58330 - DNA, 15 bp, Homo sapiens
gtttgctacttccct

SEQ ID NO: 58331 - DNA, 15 bp, Homo sapiens
tttgctacttccctc

SEQ ID NO: 58332 - DNA, 15 bp, Homo sapiens
ttgctacttccctca

SEQ ID NO: 58333 - DNA, 15 bp, Homo sapiens
tgctacttccctcac

SEQ ID NO: 58334 - DNA, 15 bp, Homo sapiens
gctacttccctcacc

SEQ ID NO: 58335 - DNA, 15 bp, Homo sapiens
ctacttccctcaccc

SEQ ID NO: 58336 - DNA, 15 bp, Homo sapiens
tacttccctcaccca

SEQ ID NO: 58337 - DNA, 15 bp, Homo sapiens
acttccctcacccac

SEQ ID NO: 58338 - DNA, 15 bp, Homo sapiens
cttccctcacccact

SEQ ID NO: 58339 - DNA, 15 bp, Homo sapiens
ttccctcacccactt

SEQ ID NO: 58340 - DNA, 15 bp, Homo sapiens
tccctcacccacttt

SEQ ID NO: 58341 - DNA, 15 bp, Homo sapiens
ccctcacccactttg

SEQ ID NO: 58342 - DNA, 15 bp, Homo sapiens
cctcacccactttgg

SEQ ID NO: 58343 - DNA, 15 bp, Homo sapiens
ctcacccactttggc

SEQ ID NO: 58344 - DNA, 15 bp, Homo sapiens
tcacccactttggcc

SEQ ID NO: 58345 - DNA, 15 bp, Homo sapiens
cacccactttggcct

SEQ ID NO: 58346 - DNA, 15 bp, Homo sapiens
acccactttggcctc

SEQ ID NO: 58347 - DNA, 15 bp, Homo sapiens
cccactttggcctcc

SEQ ID NO: 58348 - DNA, 15 bp, Homo sapiens
ccactttggcctccg

SEQ ID NO: 58349 - DNA, 15 bp, Homo sapiens
cactttggcctccgt

SEQ ID NO: 58350 - DNA, 15 bp, Homo sapiens
actttggcctccgtt

SEQ ID NO: 58351 - DNA, 15 bp, Homo sapiens
ctttggcctccgttc

SEQ ID NO: 58352 - DNA, 15 bp, Homo sapiens
tttggcctccgttca

SEQ ID NO: 58353 - DNA, 15 bp, Homo sapiens
ttggcctccgttcac

SEQ ID NO: 58354 - DNA, 15 bp, Homo sapiens
tggcctccgttcacc

SEQ ID NO: 58355 - DNA, 15 bp, Homo sapiens
ggcctccgttcaccc

SEQ ID NO: 58356 - DNA, 15 bp, Homo sapiens
gcctccgttcacccc

SEQ ID NO: 58357 - DNA, 15 bp, Homo sapiens
cctccgttcacccca

SEQ ID NO: 58358 - DNA, 15 bp, Homo sapiens
ctccgttcaccccac

SEQ ID NO: 58359 - DNA, 15 bp, Homo sapiens
tccgttcaccccacc

SEQ ID NO: 58360 - DNA, 15 bp, Homo sapiens
ccgttcaccccaccc

SEQ ID NO: 58361 - DNA, 15 bp, Homo sapiens
cgttcaccccacccc

SEQ ID NO: 58362 - DNA, 15 bp, Homo sapiens
gttcaccccacccca

SEQ ID NO: 58363 - DNA, 15 bp, Homo sapiens
ttcaccccaccccac

SEQ ID NO: 58364 - DNA, 15 bp, Homo sapiens
tcaccccaccccacc

SEQ ID NO: 58365 - DNA, 15 bp, Homo sapiens
caccccaccccaccc

SEQ ID NO: 58366 - DNA, 15 bp, Homo sapiens
accccaccccacccc

SEQ ID NO: 58367 - DNA, 15 bp, Homo sapiens
ccccaccccacccca

SEQ ID NO: 58368 - DNA, 15 bp, Homo sapiens
cccaccccaccccac

SEQ ID NO: 58369 - DNA, 15 bp, Homo sapiens
ccaccccaccccacc

SEQ ID NO: 58370 - DNA, 15 bp, Homo sapiens
caccccaccccacct

SEQ ID NO: 58371 - DNA, 15 bp, Homo sapiens
accccaccccacctc

SEQ ID NO: 58372 - DNA, 15 bp, Homo sapiens
ccccaccccacctct

SEQ ID NO: 58373 - DNA, 15 bp, Homo sapiens
cccaccccacctctc

SEQ ID NO: 58374 - DNA, 15 bp, Homo sapiens
ccaccccacctctcc

SEQ ID NO: 58375 - DNA, 15 bp, Homo sapiens
caccccacctctccc

SEQ ID NO: 58376 - DNA, 15 bp, Homo sapiens
accccacctctcccc

SEQ ID NO: 58377 - DNA, 15 bp, Homo sapiens
ccccacctctcccca

SEQ ID NO: 58378 - DNA, 15 bp, Homo sapiens
cccacctctccccac

SEQ ID NO: 58379 - DNA, 15 bp, Homo sapiens
ccacctctccccacc

SEQ ID NO: 58380 - DNA, 15 bp, Homo sapiens
cacctctccccacct

SEQ ID NO: 58381 - DNA, 15 bp, Homo sapiens
acctctccccacctt

SEQ ID NO: 58382 - DNA, 15 bp, Homo sapiens
cctctccccacctta

SEQ ID NO: 58383 - DNA, 15 bp, Homo sapiens
ctctccccaccttac

SEQ ID NO: 58384 - DNA, 15 bp, Homo sapiens
tctccccaccttacc

SEQ ID NO: 58385 - DNA, 15 bp, Homo sapiens
ctccccaccttaccc

SEQ ID NO: 58386 - DNA, 15 bp, Homo sapiens
tccccaccttacccc

SEQ ID NO: 58387 - DNA, 15 bp, Homo sapiens
ccccaccttaccccc

SEQ ID NO: 58388 - DNA, 15 bp, Homo sapiens
cccaccttacccccg

SEQ ID NO: 58389 - DNA, 15 bp, Homo sapiens
ccaccttacccccgc

SEQ ID NO: 58390 - DNA, 15 bp, Homo sapiens
caccttacccccgcc

SEQ ID NO: 58391 - DNA, 15 bp, Homo sapiens
accttacccccgccc

SEQ ID NO: 58392 - DNA, 15 bp, Homo sapiens
ccttacccccgcccc

SEQ ID NO: 58393 - DNA, 15 bp, Homo sapiens
cttacccccgccccg

SEQ ID NO: 58394 - DNA, 15 bp, Homo sapiens
ttacccccgccccgc

SEQ ID NO: 58395 - DNA, 15 bp, Homo sapiens
tacccccgccccgct

SEQ ID NO: 58396 - DNA, 15 bp, Homo sapiens
acccccgccccgctt

SEQ ID NO: 58397 - DNA, 15 bp, Homo sapiens
cccccgccccgcttg

SEQ ID NO: 58398 - DNA, 15 bp, Homo sapiens
ccccgccccgcttgg

SEQ ID NO: 58399 - DNA, 15 bp, Homo sapiens
cccgccccgcttggc

SEQ ID NO: 58400 - DNA, 15 bp, Homo sapiens
ccgccccgcttggct

SEQ ID NO: 58401 - DNA, 15 bp, Homo sapiens
cgccccgcttggctt

SEQ ID NO: 58402 - DNA, 15 bp, Homo sapiens
gccccgcttggcttc

SEQ ID NO: 58403 - DNA, 15 bp, Homo sapiens
ccccgcttggcttct

SEQ ID NO: 58404 - DNA, 15 bp, Homo sapiens
cccgcttggcttctt

SEQ ID NO: 58405 - DNA, 15 bp, Homo sapiens
ccgcttggcttcttc

SEQ ID NO: 58406 - DNA, 15 bp, Homo sapiens
cgcttggcttcttct

SEQ ID NO: 58407 - DNA, 15 bp, Homo sapiens
gcttggcttcttctt

SEQ ID NO: 58408 - DNA, 15 bp, Homo sapiens
cttggcttcttcttt

SEQ ID NO: 58409 - DNA, 15 bp, Homo sapiens
ttggcttcttcttta

SEQ ID NO: 58410 - DNA, 15 bp, Homo sapiens
tggcttcttctttag

SEQ ID NO: 58411 - DNA, 15 bp, Homo sapiens
ggcttcttctttagg

SEQ ID NO: 58412 - DNA, 15 bp, Homo sapiens
gcttcttctttagga

SEQ ID NO: 58413 - DNA, 15 bp, Homo sapiens
cttcttctttaggat

SEQ ID NO: 58414 - DNA, 15 bp, Homo sapiens
ttcttctttaggatt

SEQ ID NO: 58415 - DNA, 15 bp, Homo sapiens
tcttctttaggattg

SEQ ID NO: 58416 - DNA, 15 bp, Homo sapiens
cttctttaggattgt

SEQ ID NO: 58417 - DNA, 15 bp, Homo sapiens
ttctttaggattgtg

SEQ ID NO: 58418 - DNA, 15 bp, Homo sapiens
tctttaggattgtga

SEQ ID NO: 58419 - DNA, 15 bp, Homo sapiens
ctttaggattgtgat

SEQ ID NO: 58420 - DNA, 15 bp, Homo sapiens
tttaggattgtgatg

SEQ ID NO: 58421 - DNA, 15 bp, Homo sapiens
ttaggattgtgatgg

SEQ ID NO: 58422 - DNA, 15 bp, Homo sapiens
taggattgtgatggt

SEQ ID NO: 58423 - DNA, 15 bp, Homo sapiens
aggattgtgatggtt

SEQ ID NO: 58424 - DNA, 15 bp, Homo sapiens
ggattgtgatggttc

SEQ ID NO: 58425 - DNA, 15 bp, Homo sapiens
gattgtgatggttcg

SEQ ID NO: 58426 - DNA, 15 bp, Homo sapiens
attgtgatggttcgt

SEQ ID NO: 58427 - DNA, 15 bp, Homo sapiens
ttgtgatggttcgtt

SEQ ID NO: 58428 - DNA, 15 bp, Homo sapiens
tgtgatggttcgttc

SEQ ID NO: 58429 - DNA, 15 bp, Homo sapiens
gtgatggttcgttct

SEQ ID NO: 58430 - DNA, 15 bp, Homo sapiens
tgatggttcgttctg

SEQ ID NO: 58431 - DNA, 15 bp, Homo sapiens
gatggttcgttctgt

SEQ ID NO: 58432 - DNA, 15 bp, Homo sapiens
atggttcgttctgtt

SEQ ID NO: 58433 - DNA, 15 bp, Homo sapiens
tggttcgttctgttt

SEQ ID NO: 58434 - DNA, 15 bp, Homo sapiens
ggttcgttctgttta

SEQ ID NO: 58435 - DNA, 15 bp, Homo sapiens
gttcgttctgtttac

SEQ ID NO: 58436 - DNA, 15 bp, Homo sapiens
ttcgttctgtttaca

SEQ ID NO: 58437 - DNA, 15 bp, Homo sapiens
tcgttctgtttacat

SEQ ID NO: 58438 - DNA, 15 bp, Homo sapiens
cgttctgtttacatc

SEQ ID NO: 58439 - DNA, 15 bp, Homo sapiens
gttctgtttacatca

SEQ ID NO: 58440 - DNA, 15 bp, Homo sapiens
ttctgtttacatcag

SEQ ID NO: 58441 - DNA, 15 bp, Homo sapiens
tctgtttacatcagt

SEQ ID NO: 58442 - DNA, 15 bp, Homo sapiens
ctgtttacatcagtt

SEQ ID NO: 58443 - DNA, 15 bp, Homo sapiens
tgtttacatcagttt

SEQ ID NO: 58444 - DNA, 15 bp, Homo sapiens
gtttacatcagtttt

SEQ ID NO: 58445 - DNA, 15 bp, Homo sapiens
tttacatcagtttta

SEQ ID NO: 58446 - DNA, 15 bp, Homo sapiens
ttacatcagttttaa

SEQ ID NO: 58447 - DNA, 15 bp, Homo sapiens
tacatcagttttaac

SEQ ID NO: 58448 - DNA, 15 bp, Homo sapiens
acatcagttttaacg

SEQ ID NO: 58449 - DNA, 15 bp, Homo sapiens
catcagttttaacga

SEQ ID NO: 58450 - DNA, 15 bp, Homo sapiens
atcagttttaacgag

SEQ ID NO: 58451 - DNA, 15 bp, Homo sapiens
tcagttttaacgaga

SEQ ID NO: 58452 - DNA, 15 bp, Homo sapiens
cagttttaacgagag

SEQ ID NO: 58453 - DNA, 15 bp, Homo sapiens
agttttaacgagagg

SEQ ID NO: 58454 - DNA, 15 bp, Homo sapiens
gttttaacgagaggt

SEQ ID NO: 58455 - DNA, 15 bp, Homo sapiens
ttttaacgagaggta

SEQ ID NO: 58456 - DNA, 15 bp, Homo sapiens
tttaacgagaggtat

SEQ ID NO: 58457 - DNA, 15 bp, Homo sapiens
ttaacgagaggtatg

SEQ ID NO: 58458 - DNA, 15 bp, Homo sapiens
taacgagaggtatgc

SEQ ID NO: 58459 - DNA, 15 bp, Homo sapiens
aacgagaggtatgcc

SEQ ID NO: 58460 - DNA, 15 bp, Homo sapiens
acgagaggtatgcct

SEQ ID NO: 58461 - DNA, 15 bp, Homo sapiens
cgagaggtatgcctg

SEQ ID NO: 58462 - DNA, 15 bp, Homo sapiens
gagaggtatgcctgt

SEQ ID NO: 58463 - DNA, 15 bp, Homo sapiens
agaggtatgcctgta

SEQ ID NO: 58464 - DNA, 15 bp, Homo sapiens
gaggtatgcctgtac

SEQ ID NO: 58465 - DNA, 15 bp, Homo sapiens
aggtatgcctgtact

SEQ ID NO: 58466 - DNA, 15 bp, Homo sapiens
ggtatgcctgtactc

SEQ ID NO: 58467 - DNA, 15 bp, Homo sapiens
gtatgcctgtactcg

SEQ ID NO: 58468 - DNA, 15 bp, Homo sapiens
tatgcctgtactcgc

SEQ ID NO: 58469 - DNA, 15 bp, Homo sapiens
atgcctgtactcgct

SEQ ID NO: 58470 - DNA, 15 bp, Homo sapiens
tgcctgtactcgctt

SEQ ID NO: 58471 - DNA, 15 bp, Homo sapiens
gcctgtactcgcttg

SEQ ID NO: 58472 - DNA, 15 bp, Homo sapiens
cctgtactcgcttgt

SEQ ID NO: 58473 - DNA, 15 bp, Homo sapiens
ctgtactcgcttgtg

SEQ ID NO: 58474 - DNA, 15 bp, Homo sapiens
tgtactcgcttgtgc

SEQ ID NO: 58475 - DNA, 15 bp, Homo sapiens
gtactcgcttgtgca

SEQ ID NO: 58476 - DNA, 15 bp, Homo sapiens
tactcgcttgtgcag

SEQ ID NO: 58477 - DNA, 15 bp, Homo sapiens
actcgcttgtgcaga

SEQ ID NO: 58478 - DNA, 15 bp, Homo sapiens
ctcgcttgtgcagaa

SEQ ID NO: 58479 - DNA, 15 bp, Homo sapiens
tcgcttgtgcagaaa

SEQ ID NO: 58480 - DNA, 15 bp, Homo sapiens
cgcttgtgcagaaaa

SEQ ID NO: 58481 - DNA, 15 bp, Homo sapiens
gcttgtgcagaaaac

SEQ ID NO: 58482 - DNA, 15 bp, Homo sapiens
cttgtgcagaaaaca

SEQ ID NO: 58483 - DNA, 15 bp, Homo sapiens
ttgtgcagaaaacat

SEQ ID NO: 58484 - DNA, 15 bp, Homo sapiens
tgtgcagaaaacatt

SEQ ID NO: 58485 - DNA, 15 bp, Homo sapiens
gtgcagaaaacattg

SEQ ID NO: 58486 - DNA, 15 bp, Homo sapiens
tgcagaaaacattgt

SEQ ID NO: 58487 - DNA, 15 bp, Homo sapiens
gcagaaaacattgtt

SEQ ID NO: 58488 - DNA, 15 bp, Homo sapiens
cagaaaacattgttc

SEQ ID NO: 58489 - DNA, 15 bp, Homo sapiens
agaaaacattgttcc

SEQ ID NO: 58490 - DNA, 15 bp, Homo sapiens
gaaaacattgttcca

SEQ ID NO: 58491 - DNA, 15 bp, Homo sapiens
aaaacattgttccag

SEQ ID NO: 58492 - DNA, 15 bp, Homo sapiens
aaacattgttccaga

SEQ ID NO: 58493 - DNA, 15 bp, Homo sapiens
aacattgttccagat

SEQ ID NO: 58494 - DNA, 15 bp, Homo sapiens
acattgttccagatt

SEQ ID NO: 58495 - DNA, 15 bp, Homo sapiens
cattgttccagattc

SEQ ID NO: 58496 - DNA, 15 bp, Homo sapiens
attgttccagattca

SEQ ID NO: 58497 - DNA, 15 bp, Homo sapiens
ttgttccagattcaa

SEQ ID NO: 58498 - DNA, 15 bp, Homo sapiens
tgttccagattcaat

SEQ ID NO: 58499 - DNA, 15 bp, Homo sapiens
gttccagattcaatc

SEQ ID NO: 58500 - DNA, 15 bp, Homo sapiens
ttccagattcaatcg

SEQ ID NO: 58501 - DNA, 15 bp, Homo sapiens
tccagattcaatcga

SEQ ID NO: 58502 - DNA, 15 bp, Homo sapiens
ccagattcaatcgac

SEQ ID NO: 58503 - DNA, 15 bp, Homo sapiens
cagattcaatcgact

SEQ ID NO: 58504 - DNA, 15 bp, Homo sapiens
agattcaatcgactg

SEQ ID NO: 58505 - DNA, 15 bp, Homo sapiens
gattcaatcgactgg

SEQ ID NO: 58506 - DNA, 15 bp, Homo sapiens
attcaatcgactggg

SEQ ID NO: 58507 - DNA, 15 bp, Homo sapiens
ttcaatcgactgggt

SEQ ID NO: 58508 - DNA, 15 bp, Homo sapiens
tcaatcgactgggtt

SEQ ID NO: 58509 - DNA, 15 bp, Homo sapiens
caatcgactgggttt

SEQ ID NO: 58510 - DNA, 15 bp, Homo sapiens
aatcgactgggttta

SEQ ID NO: 58511 - DNA, 15 bp, Homo sapiens
atcgactgggtttat

SEQ ID NO: 58512 - DNA, 15 bp, Homo sapiens
tcgactgggtttatg

SEQ ID NO: 58513 - DNA, 15 bp, Homo sapiens
cgactgggtttatgt

SEQ ID NO: 58514 - DNA, 15 bp, Homo sapiens
gactgggtttatgtc

SEQ ID NO: 58515 - DNA, 15 bp, Homo sapiens
actgggtttatgtcc

SEQ ID NO: 58516 - DNA, 15 bp, Homo sapiens
ctgggtttatgtccc

SEQ ID NO: 58517 - DNA, 15 bp, Homo sapiens
tgggtttatgtccct

SEQ ID NO: 58518 - DNA, 15 bp, Homo sapiens
gggtttatgtccctt

SEQ ID NO: 58519 - DNA, 15 bp, Homo sapiens
ggtttatgtcccttc

SEQ ID NO: 58520 - DNA, 15 bp, Homo sapiens
gtttatgtcccttca

SEQ ID NO: 58521 - DNA, 15 bp, Homo sapiens
tttatgtcccttcac

SEQ ID NO: 58522 - DNA, 15 bp, Homo sapiens
ttatgtcccttcaca

SEQ ID NO: 58523 - DNA, 15 bp, Homo sapiens
tatgtcccttcacat

SEQ ID NO: 58524 - DNA, 15 bp, Homo sapiens
atgtcccttcacata

SEQ ID NO: 58525 - DNA, 15 bp, Homo sapiens
tgtcccttcacatag

SEQ ID NO: 58526 - DNA, 15 bp, Homo sapiens
gtcccttcacatagt

SEQ ID NO: 58527 - DNA, 15 bp, Homo sapiens
tcccttcacatagtt

SEQ ID NO: 58528 - DNA, 15 bp, Homo sapiens
cccttcacatagttt

SEQ ID NO: 58529 - DNA, 15 bp, Homo sapiens
ccttcacatagtttt

SEQ ID NO: 58530 - DNA, 15 bp, Homo sapiens
cttcacatagttttt

SEQ ID NO: 58531 - DNA, 15 bp, Homo sapiens
ttcacatagttttta

SEQ ID NO: 58532 - DNA, 15 bp, Homo sapiens
tcacatagtttttaa

SEQ ID NO: 58533 - DNA, 15 bp, Homo sapiens
cacatagtttttaag

SEQ ID NO: 58534 - DNA, 15 bp, Homo sapiens
acatagtttttaagg

SEQ ID NO: 58535 - DNA, 15 bp, Homo sapiens
catagtttttaaggt

SEQ ID NO: 58536 - DNA, 15 bp, Homo sapiens
atagtttttaaggtt

SEQ ID NO: 58537 - DNA, 15 bp, Homo sapiens
tagtttttaaggtta

SEQ ID NO: 58538 - DNA, 15 bp, Homo sapiens
agtttttaaggttat

SEQ ID NO: 58539 - DNA, 15 bp, Homo sapiens
gtttttaaggttatt

SEQ ID NO: 58540 - DNA, 15 bp, Homo sapiens
tttttaaggttattt

SEQ ID NO: 58541 - DNA, 15 bp, Homo sapiens
ttttaaggttattta

SEQ ID NO: 58542 - DNA, 15 bp, Homo sapiens
tttaaggttatttat

SEQ ID NO: 58543 - DNA, 15 bp, Homo sapiens
ttaaggttatttatt

SEQ ID NO: 58544 - DNA, 15 bp, Homo sapiens
taaggttatttattt

SEQ ID NO: 58545 - DNA, 15 bp, Homo sapiens
aaggttatttattta

SEQ ID NO: 58546 - DNA, 15 bp, Homo sapiens
aggttatttatttaa

SEQ ID NO: 58547 - DNA, 15 bp, Homo sapiens
ggttatttatttaaa

SEQ ID NO: 58548 - DNA, 15 bp, Homo sapiens
gttatttatttaaat

SEQ ID NO: 58549 - DNA, 15 bp, Homo sapiens
ttatttatttaaatg

SEQ ID NO: 58550 - DNA, 15 bp, Homo sapiens
tatttatttaaatgt

SEQ ID NO: 58551 - DNA, 15 bp, Homo sapiens
atttatttaaatgtc

SEQ ID NO: 58552 - DNA, 15 bp, Homo sapiens
tttatttaaatgtct

SEQ ID NO: 58553 - DNA, 15 bp, Homo sapiens
ttatttaaatgtcta

SEQ ID NO: 58554 - DNA, 15 bp, Homo sapiens
tatttaaatgtctaa

SEQ ID NO: 58555 - DNA, 15 bp, Homo sapiens
atttaaatgtctaat

SEQ ID NO: 58556 - DNA, 15 bp, Homo sapiens
tttaaatgtctaatg

SEQ ID NO: 58557 - DNA, 15 bp, Homo sapiens
ttaaatgtctaatgt

SEQ ID NO: 58558 - DNA, 15 bp, Homo sapiens
taaatgtctaatgta

SEQ ID NO: 58559 - DNA, 15 bp, Homo sapiens
aaatgtctaatgtat

SEQ ID NO: 58560 - DNA, 15 bp, Homo sapiens
aatgtctaatgtatt

SEQ ID NO: 58561 - DNA, 15 bp, Homo sapiens
atgtctaatgtattt

SEQ ID NO: 58562 - DNA, 15 bp, Homo sapiens
tgtctaatgtatttt

SEQ ID NO: 58563 - DNA, 15 bp, Homo sapiens
gtctaatgtatttta

SEQ ID NO: 58564 - DNA, 15 bp, Homo sapiens
tctaatgtattttat

SEQ ID NO: 58565 - DNA, 15 bp, Homo sapiens
ctaatgtattttatt

SEQ ID NO: 58566 - DNA, 15 bp, Homo sapiens
taatgtattttattg

SEQ ID NO: 58567 - DNA, 15 bp, Homo sapiens
aatgtattttattgt

SEQ ID NO: 58568 - DNA, 15 bp, Homo sapiens
atgtattttattgta

SEQ ID NO: 58569 - DNA, 15 bp, Homo sapiens
tgtattttattgtaa

SEQ ID NO: 58570 - DNA, 15 bp, Homo sapiens
gtattttattgtaac

SEQ ID NO: 58571 - DNA, 15 bp, Homo sapiens
tattttattgtaaca

SEQ ID NO: 58572 - DNA, 15 bp, Homo sapiens
attttattgtaacag

SEQ ID NO: 58573 - DNA, 15 bp, Homo sapiens
ttttattgtaacaga

SEQ ID NO: 58574 - DNA, 15 bp, Homo sapiens
tttattgtaacagac

SEQ ID NO: 58575 - DNA, 15 bp, Homo sapiens
ttattgtaacagaca

SEQ ID NO: 58576 - DNA, 15 bp, Homo sapiens
tattgtaacagacat

SEQ ID NO: 58577 - DNA, 15 bp, Homo sapiens
attgtaacagacatt

SEQ ID NO: 58578 - DNA, 15 bp, Homo sapiens
ttgtaacagacattg

SEQ ID NO: 58579 - DNA, 15 bp, Homo sapiens
tgtaacagacattgt

SEQ ID NO: 58580 - DNA, 15 bp, Homo sapiens
gtaacagacattgtt

SEQ ID NO: 58581 - DNA, 15 bp, Homo sapiens
taacagacattgttt

SEQ ID NO: 58582 - DNA, 15 bp, Homo sapiens
aacagacattgtttt

SEQ ID NO: 58583 - DNA, 15 bp, Homo sapiens
acagacattgttttg

SEQ ID NO: 58584 - DNA, 15 bp, Homo sapiens
cagacattgttttgc

SEQ ID NO: 58585 - DNA, 15 bp, Homo sapiens
agacattgttttgcc

SEQ ID NO: 58586 - DNA, 15 bp, Homo sapiens
gacattgttttgcca

SEQ ID NO: 58587 - DNA, 15 bp, Homo sapiens
acattgttttgccaa

SEQ ID NO: 58588 - DNA, 15 bp, Homo sapiens
cattgttttgccaac

SEQ ID NO: 58589 - DNA, 15 bp, Homo sapiens
attgttttgccaaca

SEQ ID NO: 58590 - DNA, 15 bp, Homo sapiens
ttgttttgccaacat

SEQ ID NO: 58591 - DNA, 15 bp, Homo sapiens
tgttttgccaacatt

SEQ ID NO: 58592 - DNA, 15 bp, Homo sapiens
gttttgccaacattg

SEQ ID NO: 58593 - DNA, 15 bp, Homo sapiens
ttttgccaacattgc

SEQ ID NO: 58594 - DNA, 15 bp, Homo sapiens
tttgccaacattgcc

SEQ ID NO: 58595 - DNA, 15 bp, Homo sapiens
ttgccaacattgcct

SEQ ID NO: 58596 - DNA, 15 bp, Homo sapiens
tgccaacattgccta

SEQ ID NO: 58597 - DNA, 15 bp, Homo sapiens
gccaacattgcctat

SEQ ID NO: 58598 - DNA, 15 bp, Homo sapiens
ccaacattgcctatt

SEQ ID NO: 58599 - DNA, 15 bp, Homo sapiens
caacattgcctattt

SEQ ID NO: 58600 - DNA, 15 bp, Homo sapiens
aacattgcctatttc

SEQ ID NO: 58601 - DNA, 15 bp, Homo sapiens
acattgcctatttca

SEQ ID NO: 58602 - DNA, 15 bp, Homo sapiens
cattgcctatttcag

SEQ ID NO: 58603 - DNA, 15 bp, Homo sapiens
attgcctatttcagt

SEQ ID NO: 58604 - DNA, 15 bp, Homo sapiens
ttgcctatttcagtg

SEQ ID NO: 58605 - DNA, 15 bp, Homo sapiens
tgcctatttcagtgg

SEQ ID NO: 58606 - DNA, 15 bp, Homo sapiens
gcctatttcagtggc

SEQ ID NO: 58607 - DNA, 15 bp, Homo sapiens
cctatttcagtggca

SEQ ID NO: 58608 - DNA, 15 bp, Homo sapiens
ctatttcagtggcac

SEQ ID NO: 58609 - DNA, 15 bp, Homo sapiens
tatttcagtggcacg

SEQ ID NO: 58610 - DNA, 15 bp, Homo sapiens
atttcagtggcacgt

SEQ ID NO: 58611 - DNA, 15 bp, Homo sapiens
tttcagtggcacgtc

SEQ ID NO: 58612 - DNA, 15 bp, Homo sapiens
ttcagtggcacgtca

SEQ ID NO: 58613 - DNA, 15 bp, Homo sapiens
tcagtggcacgtcat

SEQ ID NO: 58614 - DNA, 15 bp, Homo sapiens
cagtggcacgtcatc

SEQ ID NO: 58615 - DNA, 15 bp, Homo sapiens
agtggcacgtcatct

SEQ ID NO: 58616 - DNA, 15 bp, Homo sapiens
gtggcacgtcatcta

SEQ ID NO: 58617 - DNA, 15 bp, Homo sapiens
tggcacgtcatctag

SEQ ID NO: 58618 - DNA, 15 bp, Homo sapiens
ggcacgtcatctagt

SEQ ID NO: 58619 - DNA, 15 bp, Homo sapiens
gcacgtcatctagtt

SEQ ID NO: 58620 - DNA, 15 bp, Homo sapiens
cacgtcatctagttt

SEQ ID NO: 58621 - DNA, 15 bp, Homo sapiens
acgtcatctagtttt

SEQ ID NO: 58622 - DNA, 15 bp, Homo sapiens
cgtcatctagtttta

SEQ ID NO: 58623 - DNA, 15 bp, Homo sapiens
gtcatctagttttaa

SEQ ID NO: 58624 - DNA, 15 bp, Homo sapiens
tcatctagttttaaa

SEQ ID NO: 58625 - DNA, 15 bp, Homo sapiens
catctagttttaaaa

SEQ ID NO: 58626 - DNA, 15 bp, Homo sapiens
atctagttttaaaaa

SEQ ID NO: 58627 - DNA, 15 bp, Homo sapiens
tctagttttaaaaaa

SEQ ID NO: 58628 - DNA, 15 bp, Homo sapiens
ctagttttaaaaaaa

SEQ ID NO: 58629 - DNA, 15 bp, Homo sapiens
tagttttaaaaaaat

SEQ ID NO: 58630 - DNA, 15 bp, Homo sapiens
agttttaaaaaaata

SEQ ID NO: 58631 - DNA, 15 bp, Homo sapiens
gttttaaaaaaataa

SEQ ID NO: 58632 - DNA, 15 bp, Homo sapiens
ttttaaaaaaataaa

SEQ ID NO: 58633 - DNA, 15 bp, Homo sapiens
tttaaaaaaataaaa

SEQ ID NO: 58634 - DNA, 15 bp, Homo sapiens
ttaaaaaaataaaac

SEQ ID NO: 58635 - DNA, 15 bp, Homo sapiens
taaaaaaataaaaca

SEQ ID NO: 58636 - DNA, 15 bp, Homo sapiens
aaaaaaataaaacat

SEQ ID NO: 58637 - DNA, 15 bp, Homo sapiens
aaaaaataaaacatt

SEQ ID NO: 58638 - DNA, 15 bp, Homo sapiens
aaaaataaaacattt

SEQ ID NO: 58639 - DNA, 15 bp, Homo sapiens
aaaataaaacatttt

SEQ ID NO: 58640 - DNA, 15 bp, Homo sapiens
aaataaaacatttta

SEQ ID NO: 58641 - DNA, 15 bp, Homo sapiens
aataaaacattttaa

SEQ ID NO: 58642 - DNA, 15 bp, Homo sapiens
ataaaacattttaaa

SEQ ID NO: 58643 - DNA, 15 bp, Homo sapiens
taaaacattttaaat

SEQ ID NO: 58644 - DNA, 15 bp, Homo sapiens
aaaacattttaaatg

SEQ ID NO: 58645 - DNA, 15 bp, Homo sapiens
aaacattttaaatgg

SEQ ID NO: 58646 - DNA, 15 bp, Homo sapiens
aacattttaaatgga

SEQ ID NO: 58647 - DNA, 15 bp, Homo sapiens
acattttaaatggac

SEQ ID NO: 58648 - DNA, 15 bp, Homo sapiens
cattttaaatggaca

SEQ ID NO: 58649 - DNA, 15 bp, Homo sapiens
attttaaatggacag

SEQ ID NO: 58650 - DNA, 15 bp, Homo sapiens
ttttaaatggacaga

SEQ ID NO: 58651 - DNA, 15 bp, Homo sapiens
tttaaatggacagag

SEQ ID NO: 58652 - DNA, 15 bp, Homo sapiens
ttaaatggacagaga

SEQ ID NO: 58653 - DNA, 15 bp, Homo sapiens
taaatggacagagaa

SEQ ID NO: 58654 - DNA, 15 bp, Homo sapiens
aaatggacagagaaa

SEQ ID NO: 58655 - DNA, 15 bp, Homo sapiens
aatggacagagaaaa

SEQ ID NO: 58656 - DNA, 15 bp, Homo sapiens
atggacagagaaaaa

SEQ ID NO: 58657 - DNA, 15 bp, Homo sapiens
tggacagagaaaaat

SEQ ID NO: 58658 - DNA, 15 bp, Homo sapiens
ggacagagaaaaata

SEQ ID NO: 58659 - DNA, 15 bp, Homo sapiens
gacagagaaaaataa

SEQ ID NO: 58660 - DNA, 15 bp, Homo sapiens
acagagaaaaataac

SEQ ID NO: 58661 - DNA, 15 bp, Homo sapiens
cagagaaaaataact

SEQ ID NO: 58662 - DNA, 15 bp, Homo sapiens
agagaaaaataactg

SEQ ID NO: 58663 - DNA, 15 bp, Homo sapiens
gagaaaaataactgt

SEQ ID NO: 58664 - DNA, 15 bp, Homo sapiens
agaaaaataactgtc

SEQ ID NO: 58665 - DNA, 15 bp, Homo sapiens
gaaaaataactgtct

SEQ ID NO: 58666 - DNA, 15 bp, Homo sapiens
aaaaataactgtctt

SEQ ID NO: 58667 - DNA, 15 bp, Homo sapiens
aaaataactgtcttg

SEQ ID NO: 58668 - DNA, 15 bp, Homo sapiens
aaataactgtcttgt

SEQ ID NO: 58669 - DNA, 15 bp, Homo sapiens
aataactgtcttgtc

SEQ ID NO: 58670 - DNA, 15 bp, Homo sapiens
ataactgtcttgtct

SEQ ID NO: 58671 - DNA, 15 bp, Homo sapiens
taactgtcttgtctt

SEQ ID NO: 58672 - DNA, 15 bp, Homo sapiens
aactgtcttgtcttt

SEQ ID NO: 58673 - DNA, 15 bp, Homo sapiens
actgtcttgtcttta

SEQ ID NO: 58674 - DNA, 15 bp, Homo sapiens
ctgtcttgtctttaa

SEQ ID NO: 58675 - DNA, 15 bp, Homo sapiens
tgtcttgtctttaac

SEQ ID NO: 58676 - DNA, 15 bp, Homo sapiens
gtcttgtctttaact

SEQ ID NO: 58677 - DNA, 15 bp, Homo sapiens
tcttgtctttaactc

SEQ ID NO: 58678 - DNA, 15 bp, Homo sapiens
cttgtctttaactcg

SEQ ID NO: 58679 - DNA, 15 bp, Homo sapiens
ttgtctttaactcgt

SEQ ID NO: 58680 - DNA, 15 bp, Homo sapiens
tgtctttaactcgta

SEQ ID NO: 58681 - DNA, 15 bp, Homo sapiens
gtctttaactcgtaa

SEQ ID NO: 58682 - DNA, 15 bp, Homo sapiens
tctttaactcgtaag

SEQ ID NO: 58683 - DNA, 15 bp, Homo sapiens
ctttaactcgtaagt

SEQ ID NO: 58684 - DNA, 15 bp, Homo sapiens
tttaactcgtaagtg

SEQ ID NO: 58685 - DNA, 15 bp, Homo sapiens
ttaactcgtaagtgg

SEQ ID NO: 58686 - DNA, 15 bp, Homo sapiens
taactcgtaagtggc

SEQ ID NO: 58687 - DNA, 15 bp, Homo sapiens
aactcgtaagtggct

SEQ ID NO: 58688 - DNA, 15 bp, Homo sapiens
actcgtaagtggctt

SEQ ID NO: 58689 - DNA, 15 bp, Homo sapiens
ctcgtaagtggctta

SEQ ID NO: 58690 - DNA, 15 bp, Homo sapiens
tcgtaagtggcttac

SEQ ID NO: 58691 - DNA, 15 bp, Homo sapiens
cgtaagtggcttacc

SEQ ID NO: 58692 - DNA, 15 bp, Homo sapiens
gtaagtggcttacct

SEQ ID NO: 58693 - DNA, 15 bp, Homo sapiens
taagtggcttacctg

SEQ ID NO: 58694 - DNA, 15 bp, Homo sapiens
aagtggcttacctgg

SEQ ID NO: 58695 - DNA, 15 bp, Homo sapiens
agtggcttacctggg

SEQ ID NO: 58696 - DNA, 15 bp, Homo sapiens
gtggcttacctggga

SEQ ID NO: 58697 - DNA, 15 bp, Homo sapiens
tggcttacctgggac

SEQ ID NO: 58698 - DNA, 15 bp, Homo sapiens
ggcttacctgggact

SEQ ID NO: 58699 - DNA, 15 bp, Homo sapiens
gcttacctgggacta

SEQ ID NO: 58700 - DNA, 15 bp, Homo sapiens
cttacctgggactaa

SEQ ID NO: 58701 - DNA, 15 bp, Homo sapiens
ttacctgggactaac

SEQ ID NO: 58702 - DNA, 15 bp, Homo sapiens
tacctgggactaaca

SEQ ID NO: 58703 - DNA, 15 bp, Homo sapiens
acctgggactaacag

SEQ ID NO: 58704 - DNA, 15 bp, Homo sapiens
cctgggactaacaga

SEQ ID NO: 58705 - DNA, 15 bp, Homo sapiens
ctgggactaacagac

SEQ ID NO: 58706 - DNA, 15 bp, Homo sapiens
tgggactaacagaca

SEQ ID NO: 58707 - DNA, 15 bp, Homo sapiens
gggactaacagacat

SEQ ID NO: 58708 - DNA, 15 bp, Homo sapiens
ggactaacagacatg

SEQ ID NO: 58709 - DNA, 15 bp, Homo sapiens
gactaacagacatgt

SEQ ID NO: 58710 - DNA, 15 bp, Homo sapiens
actaacagacatgtc

SEQ ID NO: 58711 - DNA, 15 bp, Homo sapiens
ctaacagacatgtcc

SEQ ID NO: 58712 - DNA, 15 bp, Homo sapiens
taacagacatgtcca

SEQ ID NO: 58713 - DNA, 15 bp, Homo sapiens
aacagacatgtccaa

SEQ ID NO: 58714 - DNA, 15 bp, Homo sapiens
acagacatgtccaac

SEQ ID NO: 58715 - DNA, 15 bp, Homo sapiens
cagacatgtccaact

SEQ ID NO: 58716 - DNA, 15 bp, Homo sapiens
agacatgtccaactt

SEQ ID NO: 58717 - DNA, 15 bp, Homo sapiens
gacatgtccaacttt

SEQ ID NO: 58718 - DNA, 15 bp, Homo sapiens
acatgtccaactttc

SEQ ID NO: 58719 - DNA, 15 bp, Homo sapiens
catgtccaactttct

SEQ ID NO: 58720 - DNA, 15 bp, Homo sapiens
atgtccaactttctc

SEQ ID NO: 58721 - DNA, 15 bp, Homo sapiens
tgtccaactttctct

SEQ ID NO: 58722 - DNA, 15 bp, Homo sapiens
gtccaactttctctc

SEQ ID NO: 58723 - DNA, 15 bp, Homo sapiens
tccaactttctctcc

SEQ ID NO: 58724 - DNA, 15 bp, Homo sapiens
ccaactttctctcca

SEQ ID NO: 58725 - DNA, 15 bp, Homo sapiens
caactttctctccag

SEQ ID NO: 58726 - DNA, 15 bp, Homo sapiens
aactttctctccagt

SEQ ID NO: 58727 - DNA, 15 bp, Homo sapiens
actttctctccagtt

SEQ ID NO: 58728 - DNA, 15 bp, Homo sapiens
ctttctctccagttc

SEQ ID NO: 58729 - DNA, 15 bp, Homo sapiens
tttctctccagttct

SEQ ID NO: 58730 - DNA, 15 bp, Homo sapiens
ttctctccagttctt

SEQ ID NO: 58731 - DNA, 15 bp, Homo sapiens
tctctccagttctta

SEQ ID NO: 58732 - DNA, 15 bp, Homo sapiens
ctctccagttcttag

SEQ ID NO: 58733 - DNA, 15 bp, Homo sapiens
tctccagttcttagc

SEQ ID NO: 58734 - DNA, 15 bp, Homo sapiens
ctccagttcttagct

SEQ ID NO: 58735 - DNA, 15 bp, Homo sapiens
tccagttcttagctc

SEQ ID NO: 58736 - DNA, 15 bp, Homo sapiens
ccagttcttagctca

SEQ ID NO: 58737 - DNA, 15 bp, Homo sapiens
cagttcttagctcag

SEQ ID NO: 58738 - DNA, 15 bp, Homo sapiens
agttcttagctcaga

SEQ ID NO: 58739 - DNA, 15 bp, Homo sapiens
gttcttagctcagaa

SEQ ID NO: 58740 - DNA, 15 bp, Homo sapiens
ttcttagctcagaac

SEQ ID NO: 58741 - DNA, 15 bp, Homo sapiens
tcttagctcagaact

SEQ ID NO: 58742 - DNA, 15 bp, Homo sapiens
cttagctcagaactt

SEQ ID NO: 58743 - DNA, 15 bp, Homo sapiens
ttagctcagaacttt

SEQ ID NO: 58744 - DNA, 15 bp, Homo sapiens
tagctcagaacttta

SEQ ID NO: 58745 - DNA, 15 bp, Homo sapiens
agctcagaactttag

SEQ ID NO: 58746 - DNA, 15 bp, Homo sapiens
gctcagaactttagt

SEQ ID NO: 58747 - DNA, 15 bp, Homo sapiens
ctcagaactttagtt

SEQ ID NO: 58748 - DNA, 15 bp, Homo sapiens
tcagaactttagttg

SEQ ID NO: 58749 - DNA, 15 bp, Homo sapiens
cagaactttagttgt

SEQ ID NO: 58750 - DNA, 15 bp, Homo sapiens
agaactttagttgta

SEQ ID NO: 58751 - DNA, 15 bp, Homo sapiens
gaactttagttgtac

SEQ ID NO: 58752 - DNA, 15 bp, Homo sapiens
aactttagttgtact

SEQ ID NO: 58753 - DNA, 15 bp, Homo sapiens
actttagttgtactc

SEQ ID NO: 58754 - DNA, 15 bp, Homo sapiens
ctttagttgtactct

SEQ ID NO: 58755 - DNA, 15 bp, Homo sapiens
tttagttgtactctg

SEQ ID NO: 58756 - DNA, 15 bp, Homo sapiens
ttagttgtactctgc

SEQ ID NO: 58757 - DNA, 15 bp, Homo sapiens
tagttgtactctgct

SEQ ID NO: 58758 - DNA, 15 bp, Homo sapiens
agttgtactctgctt

SEQ ID NO: 58759 - DNA, 15 bp, Homo sapiens
gttgtactctgcttg

SEQ ID NO: 58760 - DNA, 15 bp, Homo sapiens
ttgtactctgcttga

SEQ ID NO: 58761 - DNA, 15 bp, Homo sapiens
tgtactctgcttgag

SEQ ID NO: 58762 - DNA, 15 bp, Homo sapiens
gtactctgcttgagg

SEQ ID NO: 58763 - DNA, 15 bp, Homo sapiens
tactctgcttgaggg

SEQ ID NO: 58764 - DNA, 15 bp, Homo sapiens
actctgcttgagggg

SEQ ID NO: 58765 - DNA, 15 bp, Homo sapiens
ctctgcttgagggga

SEQ ID NO: 58766 - DNA, 15 bp, Homo sapiens
tctgcttgaggggaa

SEQ ID NO: 58767 - DNA, 15 bp, Homo sapiens
ctgcttgaggggaag

SEQ ID NO: 58768 - DNA, 15 bp, Homo sapiens
tgcttgaggggaaga

SEQ ID NO: 58769 - DNA, 15 bp, Homo sapiens
gcttgaggggaagaa

SEQ ID NO: 58770 - DNA, 15 bp, Homo sapiens
cttgaggggaagaag

SEQ ID NO: 58771 - DNA, 15 bp, Homo sapiens
ttgaggggaagaagg

SEQ ID NO: 58772 - DNA, 15 bp, Homo sapiens
tgaggggaagaaggc

SEQ ID NO: 58773 - DNA, 15 bp, Homo sapiens
gaggggaagaaggct

SEQ ID NO: 58774 - DNA, 15 bp, Homo sapiens
aggggaagaaggctc

SEQ ID NO: 58775 - DNA, 15 bp, Homo sapiens
ggggaagaaggctcc

SEQ ID NO: 58776 - DNA, 15 bp, Homo sapiens
gggaagaaggctcct

SEQ ID NO: 58777 - DNA, 15 bp, Homo sapiens
ggaagaaggctcctg

SEQ ID NO: 58778 - DNA, 15 bp, Homo sapiens
gaagaaggctcctgc

SEQ ID NO: 58779 - DNA, 15 bp, Homo sapiens
aagaaggctcctgct

SEQ ID NO: 58780 - DNA, 15 bp, Homo sapiens
agaaggctcctgctc

SEQ ID NO: 58781 - DNA, 15 bp, Homo sapiens
gaaggctcctgctct

SEQ ID NO: 58782 - DNA, 15 bp, Homo sapiens
aaggctcctgctctg

SEQ ID NO: 58783 - DNA, 15 bp, Homo sapiens
aggctcctgctctgc

SEQ ID NO: 58784 - DNA, 15 bp, Homo sapiens
ggctcctgctctgct

SEQ ID NO: 58785 - DNA, 15 bp, Homo sapiens
gctcctgctctgctg

SEQ ID NO: 58786 - DNA, 15 bp, Homo sapiens
ctcctgctctgctgt

SEQ ID NO: 58787 - DNA, 15 bp, Homo sapiens
tcctgctctgctgtg

SEQ ID NO: 58788 - DNA, 15 bp, Homo sapiens
cctgctctgctgtgt

SEQ ID NO: 58789 - DNA, 15 bp, Homo sapiens
ctgctctgctgtgta

SEQ ID NO: 58790 - DNA, 15 bp, Homo sapiens
tgctctgctgtgtag

SEQ ID NO: 58791 - DNA, 15 bp, Homo sapiens
gctctgctgtgtagg

SEQ ID NO: 58792 - DNA, 15 bp, Homo sapiens
ctctgctgtgtaggt

SEQ ID NO: 58793 - DNA, 15 bp, Homo sapiens
tctgctgtgtaggta

SEQ ID NO: 58794 - DNA, 15 bp, Homo sapiens
ctgctgtgtaggtag

SEQ ID NO: 58795 - DNA, 15 bp, Homo sapiens
tgctgtgtaggtagt

SEQ ID NO: 58796 - DNA, 15 bp, Homo sapiens
gctgtgtaggtagtc

SEQ ID NO: 58797 - DNA, 15 bp, Homo sapiens
ctgtgtaggtagtca

SEQ ID NO: 58798 - DNA, 15 bp, Homo sapiens
tgtgtaggtagtcat

SEQ ID NO: 58799 - DNA, 15 bp, Homo sapiens
gtgtaggtagtcata

SEQ ID NO: 58800 - DNA, 15 bp, Homo sapiens
tgtaggtagtcatag

SEQ ID NO: 58801 - DNA, 15 bp, Homo sapiens
gtaggtagtcatagg

SEQ ID NO: 58802 - DNA, 15 bp, Homo sapiens
taggtagtcatagga

SEQ ID NO: 58803 - DNA, 15 bp, Homo sapiens
aggtagtcataggaa

SEQ ID NO: 58804 - DNA, 15 bp, Homo sapiens
ggtagtcataggaat

SEQ ID NO: 58805 - DNA, 15 bp, Homo sapiens
gtagtcataggaatt

SEQ ID NO: 58806 - DNA, 15 bp, Homo sapiens
tagtcataggaattg

SEQ ID NO: 58807 - DNA, 15 bp, Homo sapiens
agtcataggaattgt

SEQ ID NO: 58808 - DNA, 15 bp, Homo sapiens
gtcataggaattgta

SEQ ID NO: 58809 - DNA, 15 bp, Homo sapiens
tcataggaattgtat

SEQ ID NO: 58810 - DNA, 15 bp, Homo sapiens
cataggaattgtatt

SEQ ID NO: 58811 - DNA, 15 bp, Homo sapiens
ataggaattgtattc

SEQ ID NO: 58812 - DNA, 15 bp, Homo sapiens
taggaattgtattct

SEQ ID NO: 58813 - DNA, 15 bp, Homo sapiens
aggaattgtattctt

SEQ ID NO: 58814 - DNA, 15 bp, Homo sapiens
ggaattgtattctta

SEQ ID NO: 58815 - DNA, 15 bp, Homo sapiens
gaattgtattcttaa

SEQ ID NO: 58816 - DNA, 15 bp, Homo sapiens
aattgtattcttaat

SEQ ID NO: 58817 - DNA, 15 bp, Homo sapiens
attgtattcttaatg

SEQ ID NO: 58818 - DNA, 15 bp, Homo sapiens
ttgtattcttaatgt

SEQ ID NO: 58819 - DNA, 15 bp, Homo sapiens
tgtattcttaatgta

SEQ ID NO: 58820 - DNA, 15 bp, Homo sapiens
gtattcttaatgtac

SEQ ID NO: 58821 - DNA, 15 bp, Homo sapiens
tattcttaatgtaca

SEQ ID NO: 58822 - DNA, 15 bp, Homo sapiens
attcttaatgtacag

SEQ ID NO: 58823 - DNA, 15 bp, Homo sapiens
ttcttaatgtacagg

SEQ ID NO: 58824 - DNA, 15 bp, Homo sapiens
tcttaatgtacaggc

SEQ ID NO: 58825 - DNA, 15 bp, Homo sapiens
cttaatgtacaggca

SEQ ID NO: 58826 - DNA, 15 bp, Homo sapiens
ttaatgtacaggcac

SEQ ID NO: 58827 - DNA, 15 bp, Homo sapiens
taatgtacaggcact

SEQ ID NO: 58828 - DNA, 15 bp, Homo sapiens
aatgtacaggcacta

SEQ ID NO: 58829 - DNA, 15 bp, Homo sapiens
atgtacaggcactaa

SEQ ID NO: 58830 - DNA, 15 bp, Homo sapiens
tgtacaggcactaat

SEQ ID NO: 58831 - DNA, 15 bp, Homo sapiens
gtacaggcactaatt

SEQ ID NO: 58832 - DNA, 15 bp, Homo sapiens
tacaggcactaattg

SEQ ID NO: 58833 - DNA, 15 bp, Homo sapiens
acaggcactaattgt

SEQ ID NO: 58834 - DNA, 15 bp, Homo sapiens
caggcactaattgtc

SEQ ID NO: 58835 - DNA, 15 bp, Homo sapiens
aggcactaattgtca

SEQ ID NO: 58836 - DNA, 15 bp, Homo sapiens
ggcactaattgtcat

SEQ ID NO: 58837 - DNA, 15 bp, Homo sapiens
gcactaattgtcatc

SEQ ID NO: 58838 - DNA, 15 bp, Homo sapiens
cactaattgtcatct

SEQ ID NO: 58839 - DNA, 15 bp, Homo sapiens
actaattgtcatctg

SEQ ID NO: 58840 - DNA, 15 bp, Homo sapiens
ctaattgtcatctgt

SEQ ID NO: 58841 - DNA, 15 bp, Homo sapiens
taattgtcatctgtg

SEQ ID NO: 58842 - DNA, 15 bp, Homo sapiens
aattgtcatctgtga

SEQ ID NO: 58843 - DNA, 15 bp, Homo sapiens
attgtcatctgtgat

SEQ ID NO: 58844 - DNA, 15 bp, Homo sapiens
ttgtcatctgtgatg

SEQ ID NO: 58845 - DNA, 15 bp, Homo sapiens
tgtcatctgtgatgt

SEQ ID NO: 58846 - DNA, 15 bp, Homo sapiens
gtcatctgtgatgta

SEQ ID NO: 58847 - DNA, 15 bp, Homo sapiens
tcatctgtgatgtac

SEQ ID NO: 58848 - DNA, 15 bp, Homo sapiens
catctgtgatgtaca

SEQ ID NO: 58849 - DNA, 15 bp, Homo sapiens
atctgtgatgtacat

SEQ ID NO: 58850 - DNA, 15 bp, Homo sapiens
tctgtgatgtacatt

SEQ ID NO: 58851 - DNA, 15 bp, Homo sapiens
ctgtgatgtacattt

SEQ ID NO: 58852 - DNA, 15 bp, Homo sapiens
tgtgatgtacatttt

SEQ ID NO: 58853 - DNA, 15 bp, Homo sapiens
gtgatgtacatttta

SEQ ID NO: 58854 - DNA, 15 bp, Homo sapiens
tgatgtacattttat

SEQ ID NO: 58855 - DNA, 15 bp, Homo sapiens
gatgtacattttatg

SEQ ID NO: 58856 - DNA, 15 bp, Homo sapiens
atgtacattttatgc

SEQ ID NO: 58857 - DNA, 15 bp, Homo sapiens
tgtacattttatgca

SEQ ID NO: 58858 - DNA, 15 bp, Homo sapiens
gtacattttatgcaa

SEQ ID NO: 58859 - DNA, 15 bp, Homo sapiens
tacattttatgcaag

SEQ ID NO: 58860 - DNA, 15 bp, Homo sapiens
acattttatgcaagt

SEQ ID NO: 58861 - DNA, 15 bp, Homo sapiens
cattttatgcaagtt

SEQ ID NO: 58862 - DNA, 15 bp, Homo sapiens
attttatgcaagttt

SEQ ID NO: 58863 - DNA, 15 bp, Homo sapiens
ttttatgcaagtttc

SEQ ID NO: 58864 - DNA, 15 bp, Homo sapiens
tttatgcaagtttct

SEQ ID NO: 58865 - DNA, 15 bp, Homo sapiens
ttatgcaagtttctg

SEQ ID NO: 58866 - DNA, 15 bp, Homo sapiens
tatgcaagtttctgc

SEQ ID NO: 58867 - DNA, 15 bp, Homo sapiens
atgcaagtttctgct

SEQ ID NO: 58868 - DNA, 15 bp, Homo sapiens
tgcaagtttctgctg

SEQ ID NO: 58869 - DNA, 15 bp, Homo sapiens
gcaagtttctgctgg

SEQ ID NO: 58870 - DNA, 15 bp, Homo sapiens
caagtttctgctggc

SEQ ID NO: 58871 - DNA, 15 bp, Homo sapiens
aagtttctgctggcc

SEQ ID NO: 58872 - DNA, 15 bp, Homo sapiens
agtttctgctggcct

SEQ ID NO: 58873 - DNA, 15 bp, Homo sapiens
gtttctgctggcctg

SEQ ID NO: 58874 - DNA, 15 bp, Homo sapiens
tttctgctggcctgg

SEQ ID NO: 58875 - DNA, 15 bp, Homo sapiens
ttctgctggcctggt

SEQ ID NO: 58876 - DNA, 15 bp, Homo sapiens
tctgctggcctggta

SEQ ID NO: 58877 - DNA, 15 bp, Homo sapiens
ctgctggcctggtat

SEQ ID NO: 58878 - DNA, 15 bp, Homo sapiens
tgctggcctggtata

SEQ ID NO: 58879 - DNA, 15 bp, Homo sapiens
gctggcctggtatag

SEQ ID NO: 58880 - DNA, 15 bp, Homo sapiens
ctggcctggtataga

SEQ ID NO: 58881 - DNA, 15 bp, Homo sapiens
tggcctggtatagag

SEQ ID NO: 58882 - DNA, 15 bp, Homo sapiens
ggcctggtatagaga

SEQ ID NO: 58883 - DNA, 15 bp, Homo sapiens
gcctggtatagagaa

SEQ ID NO: 58884 - DNA, 15 bp, Homo sapiens
cctggtatagagaac

SEQ ID NO: 58885 - DNA, 15 bp, Homo sapiens
ctggtatagagaaca

SEQ ID NO: 58886 - DNA, 15 bp, Homo sapiens
tggtatagagaacat

SEQ ID NO: 58887 - DNA, 15 bp, Homo sapiens
ggtatagagaacata

SEQ ID NO: 58888 - DNA, 15 bp, Homo sapiens
gtatagagaacataa

SEQ ID NO: 58889 - DNA, 15 bp, Homo sapiens
tatagagaacataag

SEQ ID NO: 58890 - DNA, 15 bp, Homo sapiens
atagagaacataagg

SEQ ID NO: 58891 - DNA, 15 bp, Homo sapiens
tagagaacataaggg

SEQ ID NO: 58892 - DNA, 15 bp, Homo sapiens
agagaacataagggc

SEQ ID NO: 58893 - DNA, 15 bp, Homo sapiens
gagaacataagggca

SEQ ID NO: 58894 - DNA, 15 bp, Homo sapiens
agaacataagggcaa

SEQ ID NO: 58895 - DNA, 15 bp, Homo sapiens
gaacataagggcaag

SEQ ID NO: 58896 - DNA, 15 bp, Homo sapiens
aacataagggcaagt

SEQ ID NO: 58897 - DNA, 15 bp, Homo sapiens
acataagggcaagtg

SEQ ID NO: 58898 - DNA, 15 bp, Homo sapiens
cataagggcaagtgt

SEQ ID NO: 58899 - DNA, 15 bp, Homo sapiens
ataagggcaagtgtg

SEQ ID NO: 58900 - DNA, 15 bp, Homo sapiens
taagggcaagtgtgt

SEQ ID NO: 58901 - DNA, 15 bp, Homo sapiens
aagggcaagtgtgta

SEQ ID NO: 58902 - DNA, 15 bp, Homo sapiens
agggcaagtgtgtat

SEQ ID NO: 58903 - DNA, 15 bp, Homo sapiens
gggcaagtgtgtatg

SEQ ID NO: 58904 - DNA, 15 bp, Homo sapiens
ggcaagtgtgtatgt

SEQ ID NO: 58905 - DNA, 15 bp, Homo sapiens
gcaagtgtgtatgtg

SEQ ID NO: 58906 - DNA, 15 bp, Homo sapiens
caagtgtgtatgtgt

SEQ ID NO: 58907 - DNA, 15 bp, Homo sapiens
aagtgtgtatgtgtg

SEQ ID NO: 58908 - DNA, 15 bp, Homo sapiens
agtgtgtatgtgtgt

SEQ ID NO: 58909 - DNA, 15 bp, Homo sapiens
gtgtgtatgtgtgtg

SEQ ID NO: 58910 - DNA, 15 bp, Homo sapiens
tgtgtatgtgtgtgt

SEQ ID NO: 58911 - DNA, 15 bp, Homo sapiens
gtgtatgtgtgtgta

SEQ ID NO: 58912 - DNA, 15 bp, Homo sapiens
tgtatgtgtgtgtat

SEQ ID NO: 58913 - DNA, 15 bp, Homo sapiens
gtatgtgtgtgtatg

SEQ ID NO: 58914 - DNA, 15 bp, Homo sapiens
tatgtgtgtgtatgt

SEQ ID NO: 58915 - DNA, 15 bp, Homo sapiens
atgtgtgtgtatgtg

SEQ ID NO: 58916 - DNA, 15 bp, Homo sapiens
tgtgtgtgtatgtgt

SEQ ID NO: 58917 - DNA, 15 bp, Homo sapiens
gtgtgtgtatgtgtg

SEQ ID NO: 58918 - DNA, 15 bp, Homo sapiens
tgtgtgtatgtgtgt

SEQ ID NO: 58919 - DNA, 15 bp, Homo sapiens
tgtatgtgtgtgttt

SEQ ID NO: 58920 - DNA, 15 bp, Homo sapiens
gtatgtgtgtgtttt

SEQ ID NO: 58921 - DNA, 15 bp, Homo sapiens
tatgtgtgtgttttg

SEQ ID NO: 58922 - DNA, 15 bp, Homo sapiens
atgtgtgtgttttgt

SEQ ID NO: 58923 - DNA, 15 bp, Homo sapiens
tgtgtgtgttttgta

SEQ ID NO: 58924 - DNA, 15 bp, Homo sapiens
gtgtgtgttttgtaa

SEQ ID NO: 58925 - DNA, 15 bp, Homo sapiens
tgtgtgttttgtaaa

SEQ ID NO: 58926 - DNA, 15 bp, Homo sapiens
gtgtgttttgtaaaa

SEQ ID NO: 58927 - DNA, 15 bp, Homo sapiens
tgtgttttgtaaaat

SEQ ID NO: 58928 - DNA, 15 bp, Homo sapiens
gtgttttgtaaaatc

SEQ ID NO: 58929 - DNA, 15 bp, Homo sapiens
tgttttgtaaaatct

SEQ ID NO: 58930 - DNA, 15 bp, Homo sapiens
gttttgtaaaatctg

SEQ ID NO: 58931 - DNA, 15 bp, Homo sapiens
ttttgtaaaatctgt

SEQ ID NO: 58932 - DNA, 15 bp, Homo sapiens
tttgtaaaatctgta

SEQ ID NO: 58933 - DNA, 15 bp, Homo sapiens
ttgtaaaatctgtaa

SEQ ID NO: 58934 - DNA, 15 bp, Homo sapiens
tgtaaaatctgtaaa

SEQ ID NO: 58935 - DNA, 15 bp, Homo sapiens
gtaaaatctgtaaat

SEQ ID NO: 58936 - DNA, 15 bp, Homo sapiens
taaaatctgtaaata

SEQ ID NO: 58937 - DNA, 15 bp, Homo sapiens
aaaatctgtaaatag

SEQ ID NO: 58938 - DNA, 15 bp, Homo sapiens
aaatctgtaaatagc

SEQ ID NO: 58939 - DNA, 15 bp, Homo sapiens
aatctgtaaatagca

SEQ ID NO: 58940 - DNA, 15 bp, Homo sapiens
atctgtaaatagcac

SEQ ID NO: 58941 - DNA, 15 bp, Homo sapiens
tctgtaaatagcaca

SEQ ID NO: 58942 - DNA, 15 bp, Homo sapiens
ctgtaaatagcacat

SEQ ID NO: 58943 - DNA, 15 bp, Homo sapiens
tgtaaatagcacatg

SEQ ID NO: 58944 - DNA, 15 bp, Homo sapiens
gtaaatagcacatga

SEQ ID NO: 58945 - DNA, 15 bp, Homo sapiens
taaatagcacatgac

SEQ ID NO: 58946 - DNA, 15 bp, Homo sapiens
aaatagcacatgacc

SEQ ID NO: 58947 - DNA, 15 bp, Homo sapiens
aatagcacatgacca

SEQ ID NO: 58948 - DNA, 15 bp, Homo sapiens
atagcacatgaccaa

SEQ ID NO: 58949 - DNA, 15 bp, Homo sapiens
tagcacatgaccaaa

SEQ ID NO: 58950 - DNA, 15 bp, Homo sapiens
agcacatgaccaaat

SEQ ID NO: 58951 - DNA, 15 bp, Homo sapiens
gcacatgaccaaatg

SEQ ID NO: 58952 - DNA, 15 bp, Homo sapiens
cacatgaccaaatga

SEQ ID NO: 58953 - DNA, 15 bp, Homo sapiens
acatgaccaaatgaa

SEQ ID NO: 58954 - DNA, 15 bp, Homo sapiens
catgaccaaatgaac

SEQ ID NO: 58955 - DNA, 15 bp, Homo sapiens
atgaccaaatgaaca

SEQ ID NO: 58956 - DNA, 15 bp, Homo sapiens
tgaccaaatgaacat

SEQ ID NO: 58957 - DNA, 15 bp, Homo sapiens
gaccaaatgaacata

SEQ ID NO: 58958 - DNA, 15 bp, Homo sapiens
accaaatgaacatat

SEQ ID NO: 58959 - DNA, 15 bp, Homo sapiens
ccaaatgaacatatt

SEQ ID NO: 58960 - DNA, 15 bp, Homo sapiens
caaatgaacatattg

SEQ ID NO: 58961 - DNA, 15 bp, Homo sapiens
aaatgaacatattgt

SEQ ID NO: 58962 - DNA, 15 bp, Homo sapiens
aatgaacatattgta

SEQ ID NO: 58963 - DNA, 15 bp, Homo sapiens
atgaacatattgtat

SEQ ID NO: 58964 - DNA, 15 bp, Homo sapiens
tgaacatattgtata

SEQ ID NO: 58965 - DNA, 15 bp, Homo sapiens
gaacatattgtatag

SEQ ID NO: 58966 - DNA, 15 bp, Homo sapiens
aacatattgtataga

SEQ ID NO: 58967 - DNA, 15 bp, Homo sapiens
acatattgtatagaa

SEQ ID NO: 58968 - DNA, 15 bp, Homo sapiens
catattgtatagaac

SEQ ID NO: 58969 - DNA, 15 bp, Homo sapiens
atattgtatagaact

SEQ ID NO: 58970 - DNA, 15 bp, Homo sapiens
tattgtatagaacta

SEQ ID NO: 58971 - DNA, 15 bp, Homo sapiens
attgtatagaactat

SEQ ID NO: 58972 - DNA, 15 bp, Homo sapiens
ttgtatagaactatt

SEQ ID NO: 58973 - DNA, 15 bp, Homo sapiens
tgtatagaactattt

SEQ ID NO: 58974 - DNA, 15 bp, Homo sapiens
gtatagaactatttt

SEQ ID NO: 58975 - DNA, 15 bp, Homo sapiens
tatagaactattttt

SEQ ID NO: 58976 - DNA, 15 bp, Homo sapiens
atagaactattttta

SEQ ID NO: 58977 - DNA, 15 bp, Homo sapiens
tagaactatttttat

SEQ ID NO: 58978 - DNA, 15 bp, Homo sapiens
agaactatttttatt

SEQ ID NO: 58979 - DNA, 15 bp, Homo sapiens
gaactatttttattt

SEQ ID NO: 58980 - DNA, 15 bp, Homo sapiens
aactatttttatttg

SEQ ID NO: 58981 - DNA, 15 bp, Homo sapiens
actatttttatttga

SEQ ID NO: 58982 - DNA, 15 bp, Homo sapiens
ctatttttatttgaa

SEQ ID NO: 58983 - DNA, 15 bp, Homo sapiens
tatttttatttgaat

SEQ ID NO: 58984 - DNA, 15 bp, Homo sapiens
atttttatttgaatg

SEQ ID NO: 58985 - DNA, 15 bp, Homo sapiens
tttttatttgaatgt

SEQ ID NO: 58986 - DNA, 15 bp, Homo sapiens
ttttatttgaatgtg

SEQ ID NO: 58987 - DNA, 15 bp, Homo sapiens
tttatttgaatgtgg

SEQ ID NO: 58988 - DNA, 15 bp, Homo sapiens
ttatttgaatgtggc

SEQ ID NO: 58989 - DNA, 15 bp, Homo sapiens
tatttgaatgtggca

SEQ ID NO: 58990 - DNA, 15 bp, Homo sapiens
atttgaatgtggcac

SEQ ID NO: 58991 - DNA, 15 bp, Homo sapiens
tttgaatgtggcact

SEQ ID NO: 58992 - DNA, 15 bp, Homo sapiens
ttgaatgtggcacta

SEQ ID NO: 58993 - DNA, 15 bp, Homo sapiens
tgaatgtggcactaa

SEQ ID NO: 58994 - DNA, 15 bp, Homo sapiens
gaatgtggcactaac

SEQ ID NO: 58995 - DNA, 15 bp, Homo sapiens
aatgtggcactaacc

SEQ ID NO: 58996 - DNA, 15 bp, Homo sapiens
atgtggcactaacca

SEQ ID NO: 58997 - DNA, 15 bp, Homo sapiens
tgtggcactaaccac

SEQ ID NO: 58998 - DNA, 15 bp, Homo sapiens
gtggcactaaccacc

SEQ ID NO: 58999 - DNA, 15 bp, Homo sapiens
tggcactaaccacca

SEQ ID NO: 59000 - DNA, 15 bp, Homo sapiens
ggcactaaccaccac

SEQ ID NO: 59001 - DNA, 15 bp, Homo sapiens
gcactaaccaccacc

SEQ ID NO: 59002 - DNA, 15 bp, Homo sapiens
cactaaccaccacca

SEQ ID NO: 59003 - DNA, 15 bp, Homo sapiens
actaaccaccaccac

SEQ ID NO: 59004 - DNA, 15 bp, Homo sapiens
ctaaccaccaccacc

SEQ ID NO: 59005 - DNA, 15 bp, Homo sapiens
taaccaccaccaccg

SEQ ID NO: 59006 - DNA, 15 bp, Homo sapiens
aaccaccaccaccgt

SEQ ID NO: 59007 - DNA, 15 bp, Homo sapiens
accaccaccaccgtt

SEQ ID NO: 59008 - DNA, 15 bp, Homo sapiens
ccaccaccaccgtta

SEQ ID NO: 59009 - DNA, 15 bp, Homo sapiens
caccaccaccgttac

SEQ ID NO: 59010 - DNA, 15 bp, Homo sapiens
accaccaccgttact

SEQ ID NO: 59011 - DNA, 15 bp, Homo sapiens
ccaccaccgttacta

SEQ ID NO: 59012 - DNA, 15 bp, Homo sapiens
caccaccgttactac

SEQ ID NO: 59013 - DNA, 15 bp, Homo sapiens
accaccgttactacg

SEQ ID NO: 59014 - DNA, 15 bp, Homo sapiens
ccaccgttactacga

SEQ ID NO: 59015 - DNA, 15 bp, Homo sapiens
caccgttactacgat

SEQ ID NO: 59016 - DNA, 15 bp, Homo sapiens
accgttactacgatc

SEQ ID NO: 59017 - DNA, 15 bp, Homo sapiens
ccgttactacgatca

SEQ ID NO: 59018 - DNA, 15 bp, Homo sapiens
cgttactacgatcaa

SEQ ID NO: 59019 - DNA, 15 bp, Homo sapiens
gttactacgatcaat

SEQ ID NO: 59020 - DNA, 15 bp, Homo sapiens
ttactacgatcaatg

SEQ ID NO: 59021 - DNA, 15 bp, Homo sapiens
tactacgatcaatgt

SEQ ID NO: 59022 - DNA, 15 bp, Homo sapiens
actacgatcaatgtt

SEQ ID NO: 59023 - DNA, 15 bp, Homo sapiens
ctacgatcaatgttt

SEQ ID NO: 59024 - DNA, 15 bp, Homo sapiens
tacgatcaatgtttg

SEQ ID NO: 59025 - DNA, 15 bp, Homo sapiens
acgatcaatgtttgc

SEQ ID NO: 59026 - DNA, 15 bp, Homo sapiens
cgatcaatgtttgcg

SEQ ID NO: 59027 - DNA, 15 bp, Homo sapiens
gatcaatgtttgcgc

SEQ ID NO: 59028 - DNA, 15 bp, Homo sapiens
atcaatgtttgcgca

SEQ ID NO: 59029 - DNA, 15 bp, Homo sapiens
tcaatgtttgcgcat

SEQ ID NO: 59030 - DNA, 15 bp, Homo sapiens
caatgtttgcgcatg

SEQ ID NO: 59031 - DNA, 15 bp, Homo sapiens
aatgtttgcgcatgt

SEQ ID NO: 59032 - DNA, 15 bp, Homo sapiens
atgtttgcgcatgtt

SEQ ID NO: 59033 - DNA, 15 bp, Homo sapiens
tgtttgcgcatgttc

SEQ ID NO: 59034 - DNA, 15 bp, Homo sapiens
gtttgcgcatgttcg

SEQ ID NO: 59035 - DNA, 15 bp, Homo sapiens
tttgcgcatgttcga

SEQ ID NO: 59036 - DNA, 15 bp, Homo sapiens
ttgcgcatgttcgag

SEQ ID NO: 59037 - DNA, 15 bp, Homo sapiens
tgcgcatgttcgaga

SEQ ID NO: 59038 - DNA, 15 bp, Homo sapiens
gcgcatgttcgagat

SEQ ID NO: 59039 - DNA, 15 bp, Homo sapiens
cgcatgttcgagatg

SEQ ID NO: 59040 - DNA, 15 bp, Homo sapiens
gcatgttcgagatga

SEQ ID NO: 59041 - DNA, 15 bp, Homo sapiens
catgttcgagatgag

SEQ ID NO: 59042 - DNA, 15 bp, Homo sapiens
atgttcgagatgagt

SEQ ID NO: 59043 - DNA, 15 bp, Homo sapiens
tgttcgagatgagtc

SEQ ID NO: 59044 - DNA, 15 bp, Homo sapiens
gttcgagatgagtct

SEQ ID NO: 59045 - DNA, 15 bp, Homo sapiens
ttcgagatgagtctc

SEQ ID NO: 59046 - DNA, 15 bp, Homo sapiens
tcgagatgagtctca

SEQ ID NO: 59047 - DNA, 15 bp, Homo sapiens
cgagatgagtctcac

SEQ ID NO: 59048 - DNA, 15 bp, Homo sapiens
gagatgagtctcacc

SEQ ID NO: 59049 - DNA, 15 bp, Homo sapiens
agatgagtctcacca

SEQ ID NO: 59050 - DNA, 15 bp, Homo sapiens
gatgagtctcaccaa

SEQ ID NO: 59051 - DNA, 15 bp, Homo sapiens
atgagtctcaccaac

SEQ ID NO: 59052 - DNA, 15 bp, Homo sapiens
tgagtctcaccaaca

SEQ ID NO: 59053 - DNA, 15 bp, Homo sapiens
gagtctcaccaacag

SEQ ID NO: 59054 - DNA, 15 bp, Homo sapiens
agtctcaccaacagt

SEQ ID NO: 59055 - DNA, 15 bp, Homo sapiens
gtctcaccaacagtg

SEQ ID NO: 59056 - DNA, 15 bp, Homo sapiens
tctcaccaacagtgt

SEQ ID NO: 59057 - DNA, 15 bp, Homo sapiens
ctcaccaacagtgtg

SEQ ID NO: 59058 - DNA, 15 bp, Homo sapiens
tcaccaacagtgtgt

SEQ ID NO: 59059 - DNA, 15 bp, Homo sapiens
caccaacagtgtgta

SEQ ID NO: 59060 - DNA, 15 bp, Homo sapiens
accaacagtgtgtaa

SEQ ID NO: 59061 - DNA, 15 bp, Homo sapiens
ccaacagtgtgtaag

SEQ ID NO: 59062 - DNA, 15 bp, Homo sapiens
caacagtgtgtaagt

SEQ ID NO: 59063 - DNA, 15 bp, Homo sapiens
aacagtgtgtaagtc

SEQ ID NO: 59064 - DNA, 15 bp, Homo sapiens
acagtgtgtaagtca

SEQ ID NO: 59065 - DNA, 15 bp, Homo sapiens
cagtgtgtaagtcat

SEQ ID NO: 59066 - DNA, 15 bp, Homo sapiens
agtgtgtaagtcatt

SEQ ID NO: 59067 - DNA, 15 bp, Homo sapiens
gtgtgtaagtcatta

SEQ ID NO: 59068 - DNA, 15 bp, Homo sapiens
tgtgtaagtcattaa

SEQ ID NO: 59069 - DNA, 15 bp, Homo sapiens
gtgtaagtcattaac

SEQ ID NO: 59070 - DNA, 15 bp, Homo sapiens
tgtaagtcattaaca

SEQ ID NO: 59071 - DNA, 15 bp, Homo sapiens
gtaagtcattaacag

SEQ ID NO: 59072 - DNA, 15 bp, Homo sapiens
taagtcattaacagt

SEQ ID NO: 59073 - DNA, 15 bp, Homo sapiens
aagtcattaacagtc

SEQ ID NO: 59074 - DNA, 15 bp, Homo sapiens
agtcattaacagtcc

SEQ ID NO: 59075 - DNA, 15 bp, Homo sapiens
gtcattaacagtcct

SEQ ID NO: 59076 - DNA, 15 bp, Homo sapiens
tcattaacagtccta

SEQ ID NO: 59077 - DNA, 15 bp, Homo sapiens
cattaacagtcctaa

SEQ ID NO: 59078 - DNA, 15 bp, Homo sapiens
attaacagtcctaac

SEQ ID NO: 59079 - DNA, 15 bp, Homo sapiens
ttaacagtcctaact

SEQ ID NO: 59080 - DNA, 15 bp, Homo sapiens
taacagtcctaactg

SEQ ID NO: 59081 - DNA, 15 bp, Homo sapiens
aacagtcctaactgt

SEQ ID NO: 59082 - DNA, 15 bp, Homo sapiens
acagtcctaactgtg

SEQ ID NO: 59083 - DNA, 15 bp, Homo sapiens
cagtcctaactgtgg

SEQ ID NO: 59084 - DNA, 15 bp, Homo sapiens
agtcctaactgtggt

SEQ ID NO: 59085 - DNA, 15 bp, Homo sapiens
gtcctaactgtggtg

SEQ ID NO: 59086 - DNA, 15 bp, Homo sapiens
tcctaactgtggtgt

SEQ ID NO: 59087 - DNA, 15 bp, Homo sapiens
cctaactgtggtgtt

SEQ ID NO: 59088 - DNA, 15 bp, Homo sapiens
ctaactgtggtgttt

SEQ ID NO: 59089 - DNA, 15 bp, Homo sapiens
taactgtggtgtttt

SEQ ID NO: 59090 - DNA, 15 bp, Homo sapiens
aactgtggtgttttc

SEQ ID NO: 59091 - DNA, 15 bp, Homo sapiens
actgtggtgttttcc

SEQ ID NO: 59092 - DNA, 15 bp, Homo sapiens
ctgtggtgttttcct

SEQ ID NO: 59093 - DNA, 15 bp, Homo sapiens
tgtggtgttttcctc

SEQ ID NO: 59094 - DNA, 15 bp, Homo sapiens
gtggtgttttcctcc

SEQ ID NO: 59095 - DNA, 15 bp, Homo sapiens
tggtgttttcctcca

SEQ ID NO: 59096 - DNA, 15 bp, Homo sapiens
ggtgttttcctccaa

SEQ ID NO: 59097 - DNA, 15 bp, Homo sapiens
gtgttttcctccaat

SEQ ID NO: 59098 - DNA, 15 bp, Homo sapiens
tgttttcctccaatg

SEQ ID NO: 59099 - DNA, 15 bp, Homo sapiens
gttttcctccaatgc

SEQ ID NO: 59100 - DNA, 15 bp, Homo sapiens
ttttcctccaatgcc

SEQ ID NO: 59101 - DNA, 15 bp, Homo sapiens
tttcctccaatgcct

SEQ ID NO: 59102 - DNA, 15 bp, Homo sapiens
ttcctccaatgcctt

SEQ ID NO: 59103 - DNA, 15 bp, Homo sapiens
tcctccaatgccttc

SEQ ID NO: 59104 - DNA, 15 bp, Homo sapiens
cctccaatgccttcc

SEQ ID NO: 59105 - DNA, 15 bp, Homo sapiens
ctccaatgccttcca

SEQ ID NO: 59106 - DNA, 15 bp, Homo sapiens
tccaatgccttccaa

SEQ ID NO: 59107 - DNA, 15 bp, Homo sapiens
ccaatgccttccaac

SEQ ID NO: 59108 - DNA, 15 bp, Homo sapiens
caatgccttccaaca

SEQ ID NO: 59109 - DNA, 15 bp, Homo sapiens
aatgccttccaacat

SEQ ID NO: 59110 - DNA, 15 bp, Homo sapiens
atgccttccaacatc

SEQ ID NO: 59111 - DNA, 15 bp, Homo sapiens
tgccttccaacatcc

SEQ ID NO: 59112 - DNA, 15 bp, Homo sapiens
gccttccaacatcca

SEQ ID NO: 59113 - DNA, 15 bp, Homo sapiens
ccttccaacatccat

SEQ ID NO: 59114 - DNA, 15 bp, Homo sapiens
cttccaacatccatc

SEQ ID NO: 59115 - DNA, 15 bp, Homo sapiens
ttccaacatccatca

SEQ ID NO: 59116 - DNA, 15 bp, Homo sapiens
tccaacatccatcaa

SEQ ID NO: 59117 - DNA, 15 bp, Homo sapiens
ccaacatccatcaac

SEQ ID NO: 59118 - DNA, 15 bp, Homo sapiens
caacatccatcaact

SEQ ID NO: 59119 - DNA, 15 bp, Homo sapiens
aacatccatcaacta

SEQ ID NO: 59120 - DNA, 15 bp, Homo sapiens
acatccatcaactaa

SEQ ID NO: 59121 - DNA, 15 bp, Homo sapiens
catccatcaactaac

SEQ ID NO: 59122 - DNA, 15 bp, Homo sapiens
atccatcaactaacg

SEQ ID NO: 59123 - DNA, 15 bp, Homo sapiens
tccatcaactaacgt

SEQ ID NO: 59124 - DNA, 15 bp, Homo sapiens
ccatcaactaacgtg

SEQ ID NO: 59125 - DNA, 15 bp, Homo sapiens
catcaactaacgtga

SEQ ID NO: 59126 - DNA, 15 bp, Homo sapiens
atcaactaacgtgag

SEQ ID NO: 59127 - DNA, 15 bp, Homo sapiens
tcaactaacgtgagt

SEQ ID NO: 59128 - DNA, 15 bp, Homo sapiens
caactaacgtgagta

SEQ ID NO: 59129 - DNA, 15 bp, Homo sapiens
aactaacgtgagtat

SEQ ID NO: 59130 - DNA, 15 bp, Homo sapiens
actaacgtgagtatt

SEQ ID NO: 59131 - DNA, 15 bp, Homo sapiens
ctaacgtgagtattt

SEQ ID NO: 59132 - DNA, 15 bp, Homo sapiens
taacgtgagtatttt

SEQ ID NO: 59133 - DNA, 15 bp, Homo sapiens
aacgtgagtattttc

SEQ ID NO: 59134 - DNA, 15 bp, Homo sapiens
acgtgagtattttct

SEQ ID NO: 59135 - DNA, 15 bp, Homo sapiens
cgtgagtattttctt

SEQ ID NO: 59136 - DNA, 15 bp, Homo sapiens
gtgagtattttcttc

SEQ ID NO: 59137 - DNA, 15 bp, Homo sapiens
tgagtattttcttcc

SEQ ID NO: 59138 - DNA, 15 bp, Homo sapiens
gagtattttcttcct

SEQ ID NO: 59139 - DNA, 15 bp, Homo sapiens
agtattttcttcctg

SEQ ID NO: 59140 - DNA, 15 bp, Homo sapiens
gtattttcttcctgg

SEQ ID NO: 59141 - DNA, 15 bp, Homo sapiens
tattttcttcctggg

SEQ ID NO: 59142 - DNA, 15 bp, Homo sapiens
attttcttcctggga

SEQ ID NO: 59143 - DNA, 15 bp, Homo sapiens
ttttcttcctgggat

SEQ ID NO: 59144 - DNA, 15 bp, Homo sapiens
tttcttcctgggatt

SEQ ID NO: 59145 - DNA, 15 bp, Homo sapiens
ttcttcctgggattt

SEQ ID NO: 59146 - DNA, 15 bp, Homo sapiens
tcttcctgggatttg

SEQ ID NO: 59147 - DNA, 15 bp, Homo sapiens
cttcctgggatttgg

SEQ ID NO: 59148 - DNA, 15 bp, Homo sapiens
ttcctgggatttgga

SEQ ID NO: 59149 - DNA, 15 bp, Homo sapiens
tcctgggatttggat

SEQ ID NO: 59150 - DNA, 15 bp, Homo sapiens
cctgggatttggatg

SEQ ID NO: 59151 - DNA, 15 bp, Homo sapiens
ctgggatttggatgc

SEQ ID NO: 59152 - DNA, 15 bp, Homo sapiens
tgggatttggatgct

SEQ ID NO: 59153 - DNA, 15 bp, Homo sapiens
gggatttggatgctt

SEQ ID NO: 59154 - DNA, 15 bp, Homo sapiens
ggatttggatgcttt

SEQ ID NO: 59155 - DNA, 15 bp, Homo sapiens
gatttggatgcttta

SEQ ID NO: 59156 - DNA, 15 bp, Homo sapiens
atttggatgctttag

SEQ ID NO: 59157 - DNA, 15 bp, Homo sapiens
tttggatgctttagc

SEQ ID NO: 59158 - DNA, 15 bp, Homo sapiens
ttggatgctttagcc

SEQ ID NO: 59159 - DNA, 15 bp, Homo sapiens
tggatgctttagcct

SEQ ID NO: 59160 - DNA, 15 bp, Homo sapiens
ggatgctttagccta

SEQ ID NO: 59161 - DNA, 15 bp, Homo sapiens
gatgctttagcctaa

SEQ ID NO: 59162 - DNA, 15 bp, Homo sapiens
atgctttagcctaaa

SEQ ID NO: 59163 - DNA, 15 bp, Homo sapiens
tgctttagcctaaag

SEQ ID NO: 59164 - DNA, 15 bp, Homo sapiens
gctttagcctaaagg

SEQ ID NO: 59165 - DNA, 15 bp, Homo sapiens
ctttagcctaaaggt

SEQ ID NO: 59166 - DNA, 15 bp, Homo sapiens
tttagcctaaaggtg

SEQ ID NO: 59167 - DNA, 15 bp, Homo sapiens
ttagcctaaaggtga

SEQ ID NO: 59168 - DNA, 15 bp, Homo sapiens
tagcctaaaggtgac

SEQ ID NO: 59169 - DNA, 15 bp, Homo sapiens
agcctaaaggtgact

SEQ ID NO: 59170 - DNA, 15 bp, Homo sapiens
gcctaaaggtgactg

SEQ ID NO: 59171 - DNA, 15 bp, Homo sapiens
cctaaaggtgactgc

SEQ ID NO: 59172 - DNA, 15 bp, Homo sapiens
ctaaaggtgactgcc

SEQ ID NO: 59173 - DNA, 15 bp, Homo sapiens
taaaggtgactgcca

SEQ ID NO: 59174 - DNA, 15 bp, Homo sapiens
aaaggtgactgccac

SEQ ID NO: 59175 - DNA, 15 bp, Homo sapiens
aaggtgactgccacc

SEQ ID NO: 59176 - DNA, 15 bp, Homo sapiens
aggtgactgccacca

SEQ ID NO: 59177 - DNA, 15 bp, Homo sapiens
ggtgactgccaccaa

SEQ ID NO: 59178 - DNA, 15 bp, Homo sapiens
gtgactgccaccaag

SEQ ID NO: 59179 - DNA, 15 bp, Homo sapiens
tgactgccaccaagt

SEQ ID NO: 59180 - DNA, 15 bp, Homo sapiens
gactgccaccaagtg

SEQ ID NO: 59181 - DNA, 15 bp, Homo sapiens
actgccaccaagtga

SEQ ID NO: 59182 - DNA, 15 bp, Homo sapiens
ctgccaccaagtgag

SEQ ID NO: 59183 - DNA, 15 bp, Homo sapiens
tgccaccaagtgaga

SEQ ID NO: 59184 - DNA, 15 bp, Homo sapiens
gccaccaagtgagat

SEQ ID NO: 59185 - DNA, 15 bp, Homo sapiens
ccaccaagtgagata

SEQ ID NO: 59186 - DNA, 15 bp, Homo sapiens
caccaagtgagataa

SEQ ID NO: 59187 - DNA, 15 bp, Homo sapiens
accaagtgagataac

SEQ ID NO: 59188 - DNA, 15 bp, Homo sapiens
ccaagtgagataact

SEQ ID NO: 59189 - DNA, 15 bp, Homo sapiens
caagtgagataactg

SEQ ID NO: 59190 - DNA, 15 bp, Homo sapiens
aagtgagataactgt

SEQ ID NO: 59191 - DNA, 15 bp, Homo sapiens
agtgagataactgta

SEQ ID NO: 59192 - DNA, 15 bp, Homo sapiens
gtgagataactgtat

SEQ ID NO: 59193 - DNA, 15 bp, Homo sapiens
tgagataactgtatg

SEQ ID NO: 59194 - DNA, 15 bp, Homo sapiens
gagataactgtatgt

SEQ ID NO: 59195 - DNA, 15 bp, Homo sapiens
agataactgtatgtc

SEQ ID NO: 59196 - DNA, 15 bp, Homo sapiens
gataactgtatgtca

SEQ ID NO: 59197 - DNA, 15 bp, Homo sapiens
ataactgtatgtcac

SEQ ID NO: 59198 - DNA, 15 bp, Homo sapiens
taactgtatgtcact

SEQ ID NO: 59199 - DNA, 15 bp, Homo sapiens
aactgtatgtcacta

SEQ ID NO: 59200 - DNA, 15 bp, Homo sapiens
actgtatgtcactaa

SEQ ID NO: 59201 - DNA, 15 bp, Homo sapiens
ctgtatgtcactaac

SEQ ID NO: 59202 - DNA, 15 bp, Homo sapiens
tgtatgtcactaact

SEQ ID NO: 59203 - DNA, 15 bp, Homo sapiens
gtatgtcactaactt

SEQ ID NO: 59204 - DNA, 15 bp, Homo sapiens
tatgtcactaactta

SEQ ID NO: 59205 - DNA, 15 bp, Homo sapiens
atgtcactaacttat

SEQ ID NO: 59206 - DNA, 15 bp, Homo sapiens
tgtcactaacttata

SEQ ID NO: 59207 - DNA, 15 bp, Homo sapiens
gtcactaacttataa

SEQ ID NO: 59208 - DNA, 15 bp, Homo sapiens
tcactaacttataag

SEQ ID NO: 59209 - DNA, 15 bp, Homo sapiens
cactaacttataagc

SEQ ID NO: 59210 - DNA, 15 bp, Homo sapiens
actaacttataagcc

SEQ ID NO: 59211 - DNA, 15 bp, Homo sapiens
ctaacttataagccg

SEQ ID NO: 59212 - DNA, 15 bp, Homo sapiens
taacttataagccgc

SEQ ID NO: 59213 - DNA, 15 bp, Homo sapiens
aacttataagccgcc

SEQ ID NO: 59214 - DNA, 15 bp, Homo sapiens
acttataagccgcct

SEQ ID NO: 59215 - DNA, 15 bp, Homo sapiens
cttataagccgcctc

SEQ ID NO: 59216 - DNA, 15 bp, Homo sapiens
ttataagccgcctcc

SEQ ID NO: 59217 - DNA, 15 bp, Homo sapiens
tataagccgcctcca

SEQ ID NO: 59218 - DNA, 15 bp, Homo sapiens
ataagccgcctccat

SEQ ID NO: 59219 - DNA, 15 bp, Homo sapiens
taagccgcctccatg

SEQ ID NO: 59220 - DNA, 15 bp, Homo sapiens
aagccgcctccatgg

SEQ ID NO: 59221 - DNA, 15 bp, Homo sapiens
agccgcctccatggc

SEQ ID NO: 59222 - DNA, 15 bp, Homo sapiens
gccgcctccatggca

SEQ ID NO: 59223 - DNA, 15 bp, Homo sapiens
ccgcctccatggcag

SEQ ID NO: 59224 - DNA, 15 bp, Homo sapiens
cgcctccatggcaga

SEQ ID NO: 59225 - DNA, 15 bp, Homo sapiens
gcctccatggcagat

SEQ ID NO: 59226 - DNA, 15 bp, Homo sapiens
cctccatggcagatg

SEQ ID NO: 59227 - DNA, 15 bp, Homo sapiens
ctccatggcagatgc

SEQ ID NO: 59228 - DNA, 15 bp, Homo sapiens
tccatggcagatgct

SEQ ID NO: 59229 - DNA, 15 bp, Homo sapiens
ccatggcagatgctg

SEQ ID NO: 59230 - DNA, 15 bp, Homo sapiens
catggcagatgctgc

SEQ ID NO: 59231 - DNA, 15 bp, Homo sapiens
atggcagatgctgct

SEQ ID NO: 59232 - DNA, 15 bp, Homo sapiens
tggcagatgctgctg

SEQ ID NO: 59233 - DNA, 15 bp, Homo sapiens
ggcagatgctgctgt

SEQ ID NO: 59234 - DNA, 15 bp, Homo sapiens
gcagatgctgctgtg

SEQ ID NO: 59235 - DNA, 15 bp, Homo sapiens
cagatgctgctgtgc

SEQ ID NO: 59236 - DNA, 15 bp, Homo sapiens
agatgctgctgtgct

SEQ ID NO: 59237 - DNA, 15 bp, Homo sapiens
gatgctgctgtgctc

SEQ ID NO: 59238 - DNA, 15 bp, Homo sapiens
atgctgctgtgctcc

SEQ ID NO: 59239 - DNA, 15 bp, Homo sapiens
tgctgctgtgctccc

SEQ ID NO: 59240 - DNA, 15 bp, Homo sapiens
gctgctgtgctccct

SEQ ID NO: 59241 - DNA, 15 bp, Homo sapiens
ctgctgtgctccctg

SEQ ID NO: 59242 - DNA, 15 bp, Homo sapiens
tgctgtgctccctga

SEQ ID NO: 59243 - DNA, 15 bp, Homo sapiens
gctgtgctccctgat

SEQ ID NO: 59244 - DNA, 15 bp, Homo sapiens
ctgtgctccctgatg

SEQ ID NO: 59245 - DNA, 15 bp, Homo sapiens
tgtgctccctgatgc

SEQ ID NO: 59246 - DNA, 15 bp, Homo sapiens
gtgctccctgatgcc

SEQ ID NO: 59247 - DNA, 15 bp, Homo sapiens
tgctccctgatgccc

SEQ ID NO: 59248 - DNA, 15 bp, Homo sapiens
gctccctgatgccct

SEQ ID NO: 59249 - DNA, 15 bp, Homo sapiens
ctccctgatgccctg

SEQ ID NO: 59250 - DNA, 15 bp, Homo sapiens
tccctgatgccctgt

SEQ ID NO: 59251 - DNA, 15 bp, Homo sapiens
ccctgatgccctgtg

SEQ ID NO: 59252 - DNA, 15 bp, Homo sapiens
cctgatgccctgtga

SEQ ID NO: 59253 - DNA, 15 bp, Homo sapiens
ctgatgccctgtgag

SEQ ID NO: 59254 - DNA, 15 bp, Homo sapiens
tgatgccctgtgagc

SEQ ID NO: 59255 - DNA, 15 bp, Homo sapiens
gatgccctgtgagca

SEQ ID NO: 59256 - DNA, 15 bp, Homo sapiens
atgccctgtgagcac

SEQ ID NO: 59257 - DNA, 15 bp, Homo sapiens
tgccctgtgagcacc

SEQ ID NO: 59258 - DNA, 15 bp, Homo sapiens
gccctgtgagcaccg

SEQ ID NO: 59259 - DNA, 15 bp, Homo sapiens
ccctgtgagcaccgg

SEQ ID NO: 59260 - DNA, 15 bp, Homo sapiens
cctgtgagcaccggg

SEQ ID NO: 59261 - DNA, 15 bp, Homo sapiens
ctgtgagcaccgggg

SEQ ID NO: 59262 - DNA, 15 bp, Homo sapiens
tgtgagcaccggggt

SEQ ID NO: 59263 - DNA, 15 bp, Homo sapiens
gtgagcaccggggtt

SEQ ID NO: 59264 - DNA, 15 bp, Homo sapiens
tgagcaccggggttg

SEQ ID NO: 59265 - DNA, 15 bp, Homo sapiens
gagcaccggggttgc

SEQ ID NO: 59266 - DNA, 15 bp, Homo sapiens
agcaccggggttgcc

SEQ ID NO: 59267 - DNA, 15 bp, Homo sapiens
gcaccggggttgcct

SEQ ID NO: 59268 - DNA, 15 bp, Homo sapiens
caccggggttgcctg

SEQ ID NO: 59269 - DNA, 15 bp, Homo sapiens
accggggttgcctgt

SEQ ID NO: 59270 - DNA, 15 bp, Homo sapiens
ccggggttgcctgtg

SEQ ID NO: 59271 - DNA, 15 bp, Homo sapiens
cggggttgcctgtgg

SEQ ID NO: 59272 - DNA, 15 bp, Homo sapiens
ggggttgcctgtggc

SEQ ID NO: 59273 - DNA, 15 bp, Homo sapiens
gggttgcctgtggcg

SEQ ID NO: 59274 - DNA, 15 bp, Homo sapiens
ggttgcctgtggcgc

SEQ ID NO: 59275 - DNA, 15 bp, Homo sapiens
gttgcctgtggcgcc

SEQ ID NO: 59276 - DNA, 15 bp, Homo sapiens
ttgcctgtggcgcct

SEQ ID NO: 59277 - DNA, 15 bp, Homo sapiens
tgcctgtggcgcctg

SEQ ID NO: 59278 - DNA, 15 bp, Homo sapiens
gcctgtggcgcctgc

SEQ ID NO: 59279 - DNA, 15 bp, Homo sapiens
cctgtggcgcctgcc

SEQ ID NO: 59280 - DNA, 15 bp, Homo sapiens
ctgtggcgcctgcca

SEQ ID NO: 59281 - DNA, 15 bp, Homo sapiens
tgtggcgcctgccat

SEQ ID NO: 59282 - DNA, 15 bp, Homo sapiens
gtggcgcctgccatg

SEQ ID NO: 59283 - DNA, 15 bp, Homo sapiens
tggcgcctgccatgt

SEQ ID NO: 59284 - DNA, 15 bp, Homo sapiens
ggcgcctgccatgtg

SEQ ID NO: 59285 - DNA, 15 bp, Homo sapiens
gcgcctgccatgtga

SEQ ID NO: 59286 - DNA, 15 bp, Homo sapiens
cgcctgccatgtgac

SEQ ID NO: 59287 - DNA, 15 bp, Homo sapiens
gcctgccatgtgact

SEQ ID NO: 59288 - DNA, 15 bp, Homo sapiens
cctgccatgtgactc

SEQ ID NO: 59289 - DNA, 15 bp, Homo sapiens
ctgccatgtgactcg

SEQ ID NO: 59290 - DNA, 15 bp, Homo sapiens
tgccatgtgactcgg

SEQ ID NO: 59291 - DNA, 15 bp, Homo sapiens
gccatgtgactcggg

SEQ ID NO: 59292 - DNA, 15 bp, Homo sapiens
ccatgtgactcgggc

SEQ ID NO: 59293 - DNA, 15 bp, Homo sapiens
catgtgactcgggcg

SEQ ID NO: 59294 - DNA, 15 bp, Homo sapiens
atgtgactcgggcgc

SEQ ID NO: 59295 - DNA, 15 bp, Homo sapiens
tgtgactcgggcgca

SEQ ID NO: 59296 - DNA, 15 bp, Homo sapiens
gtgactcgggcgcag

SEQ ID NO: 59297 - DNA, 15 bp, Homo sapiens
tgactcgggcgcagc

SEQ ID NO: 59298 - DNA, 15 bp, Homo sapiens
gactcgggcgcagca

SEQ ID NO: 59299 - DNA, 15 bp, Homo sapiens
actcgggcgcagcat

SEQ ID NO: 59300 - DNA, 15 bp, Homo sapiens
ctcgggcgcagcatc

SEQ ID NO: 59301 - DNA, 15 bp, Homo sapiens
tcgggcgcagcatca

SEQ ID NO: 59302 - DNA, 15 bp, Homo sapiens
cgggcgcagcatcag

SEQ ID NO: 59303 - DNA, 15 bp, Homo sapiens
gggcgcagcatcagc

SEQ ID NO: 59304 - DNA, 15 bp, Homo sapiens
ggcgcagcatcagct

SEQ ID NO: 59305 - DNA, 15 bp, Homo sapiens
gcgcagcatcagctg

SEQ ID NO: 59306 - DNA, 15 bp, Homo sapiens
cgcagcatcagctgg

SEQ ID NO: 59307 - DNA, 15 bp, Homo sapiens
gcagcatcagctggc

SEQ ID NO: 59308 - DNA, 15 bp, Homo sapiens
cagcatcagctggct

SEQ ID NO: 59309 - DNA, 15 bp, Homo sapiens
agcatcagctggctg

SEQ ID NO: 59310 - DNA, 15 bp, Homo sapiens
gcatcagctggctgg

SEQ ID NO: 59311 - DNA, 15 bp, Homo sapiens
catcagctggctgga

SEQ ID NO: 59312 - DNA, 15 bp, Homo sapiens
atcagctggctggag

SEQ ID NO: 59313 - DNA, 15 bp, Homo sapiens
tcagctggctggagg

SEQ ID NO: 59314 - DNA, 15 bp, Homo sapiens
cagctggctggaggt

SEQ ID NO: 59315 - DNA, 15 bp, Homo sapiens
agctggctggaggtg

SEQ ID NO: 59316 - DNA, 15 bp, Homo sapiens
gctggctggaggtgt

SEQ ID NO: 59317 - DNA, 15 bp, Homo sapiens
ctggctggaggtgtg

SEQ ID NO: 59318 - DNA, 15 bp, Homo sapiens
tggctggaggtgtgg

SEQ ID NO: 59319 - DNA, 15 bp, Homo sapiens
ggctggaggtgtggc

SEQ ID NO: 59320 - DNA, 15 bp, Homo sapiens
gctggaggtgtggct

SEQ ID NO: 59321 - DNA, 15 bp, Homo sapiens
ctggaggtgtggctt

SEQ ID NO: 59322 - DNA, 15 bp, Homo sapiens
tggaggtgtggcttt

SEQ ID NO: 59323 - DNA, 15 bp, Homo sapiens
ggaggtgtggctttc

SEQ ID NO: 59324 - DNA, 15 bp, Homo sapiens
gaggtgtggctttca

SEQ ID NO: 59325 - DNA, 15 bp, Homo sapiens
aggtgtggctttcat

SEQ ID NO: 59326 - DNA, 15 bp, Homo sapiens
ggtgtggctttcata

SEQ ID NO: 59327 - DNA, 15 bp, Homo sapiens
gtgtggctttcatag

SEQ ID NO: 59328 - DNA, 15 bp, Homo sapiens
tgtggctttcataga

SEQ ID NO: 59329 - DNA, 15 bp, Homo sapiens
gtggctttcatagac

SEQ ID NO: 59330 - DNA, 15 bp, Homo sapiens
tggctttcatagacc

SEQ ID NO: 59331 - DNA, 15 bp, Homo sapiens
ggctttcatagacct

SEQ ID NO: 59332 - DNA, 15 bp, Homo sapiens
gctttcatagacctc

SEQ ID NO: 59333 - DNA, 15 bp, Homo sapiens
ctttcatagacctcc

SEQ ID NO: 59334 - DNA, 15 bp, Homo sapiens
tttcatagacctcca

SEQ ID NO: 59335 - DNA, 15 bp, Homo sapiens
ttcatagacctccac

SEQ ID NO: 59336 - DNA, 15 bp, Homo sapiens
tcatagacctccaca

SEQ ID NO: 59337 - DNA, 15 bp, Homo sapiens
catagacctccacag

SEQ ID NO: 59338 - DNA, 15 bp, Homo sapiens
atagacctccacagg

SEQ ID NO: 59339 - DNA, 15 bp, Homo sapiens
tagacctccacaggc

SEQ ID NO: 59340 - DNA, 15 bp, Homo sapiens
agacctccacaggct

SEQ ID NO: 59341 - DNA, 15 bp, Homo sapiens
gacctccacaggctg

SEQ ID NO: 59342 - DNA, 15 bp, Homo sapiens
acctccacaggctgc

SEQ ID NO: 59343 - DNA, 15 bp, Homo sapiens
cctccacaggctgcc

SEQ ID NO: 59344 - DNA, 15 bp, Homo sapiens
ctccacaggctgcct

SEQ ID NO: 59345 - DNA, 15 bp, Homo sapiens
tccacaggctgccta

SEQ ID NO: 59346 - DNA, 15 bp, Homo sapiens
ccacaggctgcctag

SEQ ID NO: 59347 - DNA, 15 bp, Homo sapiens
cacaggctgcctagg

SEQ ID NO: 59348 - DNA, 15 bp, Homo sapiens
acaggctgcctagga

SEQ ID NO: 59349 - DNA, 15 bp, Homo sapiens
caggctgcctaggac

SEQ ID NO: 59350 - DNA, 15 bp, Homo sapiens
aggctgcctaggaca

SEQ ID NO: 59351 - DNA, 15 bp, Homo sapiens
ggctgcctaggacaa

SEQ ID NO: 59352 - DNA, 15 bp, Homo sapiens
gctgcctaggacaag

SEQ ID NO: 59353 - DNA, 15 bp, Homo sapiens
ctgcctaggacaaga

SEQ ID NO: 59354 - DNA, 15 bp, Homo sapiens
tgcctaggacaagat

SEQ ID NO: 59355 - DNA, 15 bp, Homo sapiens
gcctaggacaagatg

SEQ ID NO: 59356 - DNA, 15 bp, Homo sapiens
cctaggacaagatga

SEQ ID NO: 59357 - DNA, 15 bp, Homo sapiens
ctaggacaagatgac

SEQ ID NO: 59358 - DNA, 15 bp, Homo sapiens
taggacaagatgacc

SEQ ID NO: 59359 - DNA, 15 bp, Homo sapiens
aggacaagatgacca

SEQ ID NO: 59360 - DNA, 15 bp, Homo sapiens
ggacaagatgaccag

SEQ ID NO: 59361 - DNA, 15 bp, Homo sapiens
gacaagatgaccagg

SEQ ID NO: 59362 - DNA, 15 bp, Homo sapiens
acaagatgaccagga

SEQ ID NO: 59363 - DNA, 15 bp, Homo sapiens
caagatgaccaggag

SEQ ID NO: 59364 - DNA, 15 bp, Homo sapiens
aagatgaccaggagg

SEQ ID NO: 59365 - DNA, 15 bp, Homo sapiens
agatgaccaggaggg

SEQ ID NO: 59366 - DNA, 15 bp, Homo sapiens
gatgaccaggagggc

SEQ ID NO: 59367 - DNA, 15 bp, Homo sapiens
atgaccaggagggcc

SEQ ID NO: 59368 - DNA, 15 bp, Homo sapiens
tgaccaggagggccc

SEQ ID NO: 59369 - DNA, 15 bp, Homo sapiens
gaccaggagggccca

SEQ ID NO: 59370 - DNA, 15 bp, Homo sapiens
accaggagggcccaa

SEQ ID NO: 59371 - DNA, 15 bp, Homo sapiens
ccaggagggcccaag

SEQ ID NO: 59372 - DNA, 15 bp, Homo sapiens
caggagggcccaagc

SEQ ID NO: 59373 - DNA, 15 bp, Homo sapiens
aggagggcccaagcc

SEQ ID NO: 59374 - DNA, 15 bp, Homo sapiens
ggagggcccaagcca

SEQ ID NO: 59375 - DNA, 15 bp, Homo sapiens
gagggcccaagccag

SEQ ID NO: 59376 - DNA, 15 bp, Homo sapiens
agggcccaagccaga

SEQ ID NO: 59377 - DNA, 15 bp, Homo sapiens
gggcccaagccagac

SEQ ID NO: 59378 - DNA, 15 bp, Homo sapiens
ggcccaagccagaca

SEQ ID NO: 59379 - DNA, 15 bp, Homo sapiens
gcccaagccagacaa

SEQ ID NO: 59380 - DNA, 15 bp, Homo sapiens
cccaagccagacaaa

SEQ ID NO: 59381 - DNA, 15 bp, Homo sapiens
ccaagccagacaaaa

SEQ ID NO: 59382 - DNA, 15 bp, Homo sapiens
caagccagacaaaag

SEQ ID NO: 59383 - DNA, 15 bp, Homo sapiens
aagccagacaaaagc

SEQ ID NO: 59384 - DNA, 15 bp, Homo sapiens
agccagacaaaagcc

SEQ ID NO: 59385 - DNA, 15 bp, Homo sapiens
gccagacaaaagccg

SEQ ID NO: 59386 - DNA, 15 bp, Homo sapiens
ccagacaaaagccgg

SEQ ID NO: 59387 - DNA, 15 bp, Homo sapiens
cagacaaaagccgga

SEQ ID NO: 59388 - DNA, 15 bp, Homo sapiens
agacaaaagccggag

SEQ ID NO: 59389 - DNA, 15 bp, Homo sapiens
gacaaaagccggagt

SEQ ID NO: 59390 - DNA, 15 bp, Homo sapiens
acaaaagccggagtg

SEQ ID NO: 59391 - DNA, 15 bp, Homo sapiens
caaaagccggagtgg

SEQ ID NO: 59392 - DNA, 15 bp, Homo sapiens
aaaagccggagtggg

SEQ ID NO: 59393 - DNA, 15 bp, Homo sapiens
aaagccggagtgggg

SEQ ID NO: 59394 - DNA, 15 bp, Homo sapiens
aagccggagtgggga

SEQ ID NO: 59395 - DNA, 15 bp, Homo sapiens
agccggagtggggag

SEQ ID NO: 59396 - DNA, 15 bp, Homo sapiens
gccggagtggggaga

SEQ ID NO: 59397 - DNA, 15 bp, Homo sapiens
ccggagtggggagag

SEQ ID NO: 59398 - DNA, 15 bp, Homo sapiens
cggagtggggagaga

SEQ ID NO: 59399 - DNA, 15 bp, Homo sapiens
ggagtggggagagag

SEQ ID NO: 59400 - DNA, 15 bp, Homo sapiens
gagtggggagagagg

SEQ ID NO: 59401 - DNA, 15 bp, Homo sapiens
agtggggagagaggc

SEQ ID NO: 59402 - DNA, 15 bp, Homo sapiens
gtggggagagaggca

SEQ ID NO: 59403 - DNA, 15 bp, Homo sapiens
tggggagagaggcat

SEQ ID NO: 59404 - DNA, 15 bp, Homo sapiens
ggggagagaggcatt

SEQ ID NO: 59405 - DNA, 15 bp, Homo sapiens
gggagagaggcattt

SEQ ID NO: 59406 - DNA, 15 bp, Homo sapiens
ggagagaggcatttc

SEQ ID NO: 59407 - DNA, 15 bp, Homo sapiens
gagagaggcatttca

SEQ ID NO: 59408 - DNA, 15 bp, Homo sapiens
agagaggcatttcag

SEQ ID NO: 59409 - DNA, 15 bp, Homo sapiens
gagaggcatttcagc

SEQ ID NO: 59410 - DNA, 15 bp, Homo sapiens
agaggcatttcagcc

SEQ ID NO: 59411 - DNA, 15 bp, Homo sapiens
gaggcatttcagcca

SEQ ID NO: 59412 - DNA, 15 bp, Homo sapiens
aggcatttcagccag

SEQ ID NO: 59413 - DNA, 15 bp, Homo sapiens
ggcatttcagccaga

SEQ ID NO: 59414 - DNA, 15 bp, Homo sapiens
gcatttcagccagac

SEQ ID NO: 59415 - DNA, 15 bp, Homo sapiens
catttcagccagacc

SEQ ID NO: 59416 - DNA, 15 bp, Homo sapiens
atttcagccagacca

SEQ ID NO: 59417 - DNA, 15 bp, Homo sapiens
tttcagccagaccaa

SEQ ID NO: 59418 - DNA, 15 bp, Homo sapiens
ttcagccagaccaac

SEQ ID NO: 59419 - DNA, 15 bp, Homo sapiens
tcagccagaccaaca

SEQ ID NO: 59420 - DNA, 15 bp, Homo sapiens
cagccagaccaacag

SEQ ID NO: 59421 - DNA, 15 bp, Homo sapiens
agccagaccaacagg

SEQ ID NO: 59422 - DNA, 15 bp, Homo sapiens
gccagaccaacaggc

SEQ ID NO: 59423 - DNA, 15 bp, Homo sapiens
ccagaccaacaggct

SEQ ID NO: 59424 - DNA, 15 bp, Homo sapiens
cagaccaacaggctg

SEQ ID NO: 59425 - DNA, 15 bp, Homo sapiens
agaccaacaggctga

SEQ ID NO: 59426 - DNA, 15 bp, Homo sapiens
gaccaacaggctgaa

SEQ ID NO: 59427 - DNA, 15 bp, Homo sapiens
accaacaggctgaag

SEQ ID NO: 59428 - DNA, 15 bp, Homo sapiens
ccaacaggctgaagg

SEQ ID NO: 59429 - DNA, 15 bp, Homo sapiens
caacaggctgaagga

SEQ ID NO: 59430 - DNA, 15 bp, Homo sapiens
aacaggctgaaggag

SEQ ID NO: 59431 - DNA, 15 bp, Homo sapiens
acaggctgaaggagc

SEQ ID NO: 59432 - DNA, 15 bp, Homo sapiens
caggctgaaggagct

SEQ ID NO: 59433 - DNA, 15 bp, Homo sapiens
aggctgaaggagctg

SEQ ID NO: 59434 - DNA, 15 bp, Homo sapiens
ggctgaaggagctgt

SEQ ID NO: 59435 - DNA, 15 bp, Homo sapiens
gctgaaggagctgtg

SEQ ID NO: 59436 - DNA, 15 bp, Homo sapiens
ctgaaggagctgtgc

SEQ ID NO: 59437 - DNA, 15 bp, Homo sapiens
tgaaggagctgtgca

SEQ ID NO: 59438 - DNA, 15 bp, Homo sapiens
gaaggagctgtgcag

SEQ ID NO: 59439 - DNA, 15 bp, Homo sapiens
aaggagctgtgcaga

SEQ ID NO: 59440 - DNA, 15 bp, Homo sapiens
aggagctgtgcagac

SEQ ID NO: 59441 - DNA, 15 bp, Homo sapiens
ggagctgtgcagact

SEQ ID NO: 59442 - DNA, 15 bp, Homo sapiens
gagctgtgcagacta

SEQ ID NO: 59443 - DNA, 15 bp, Homo sapiens
agctgtgcagactat

SEQ ID NO: 59444 - DNA, 15 bp, Homo sapiens
gctgtgcagactatt

SEQ ID NO: 59445 - DNA, 15 bp, Homo sapiens
ctgtgcagactattg

SEQ ID NO: 59446 - DNA, 15 bp, Homo sapiens
tgtgcagactattgc

SEQ ID NO: 59447 - DNA, 15 bp, Homo sapiens
gtgcagactattgct

SEQ ID NO: 59448 - DNA, 15 bp, Homo sapiens
tgcagactattgcta

SEQ ID NO: 59449 - DNA, 15 bp, Homo sapiens
gcagactattgctaa

SEQ ID NO: 59450 - DNA, 15 bp, Homo sapiens
cagactattgctaaa

SEQ ID NO: 59451 - DNA, 15 bp, Homo sapiens
agactattgctaaaa

SEQ ID NO: 59452 - DNA, 15 bp, Homo sapiens
gactattgctaaaat

SEQ ID NO: 59453 - DNA, 15 bp, Homo sapiens
actattgctaaaatg

SEQ ID NO: 59454 - DNA, 15 bp, Homo sapiens
ctattgctaaaatga

SEQ ID NO: 59455 - DNA, 15 bp, Homo sapiens
tattgctaaaatgag

SEQ ID NO: 59456 - DNA, 15 bp, Homo sapiens
attgctaaaatgagg

SEQ ID NO: 59457 - DNA, 15 bp, Homo sapiens
ttgctaaaatgaggg

SEQ ID NO: 59458 - DNA, 15 bp, Homo sapiens
tgctaaaatgagggt

SEQ ID NO: 59459 - DNA, 15 bp, Homo sapiens
gctaaaatgagggtt

SEQ ID NO: 59460 - DNA, 15 bp, Homo sapiens
ctaaaatgagggttc

SEQ ID NO: 59461 - DNA, 15 bp, Homo sapiens
taaaatgagggttcg

SEQ ID NO: 59462 - DNA, 15 bp, Homo sapiens
aaaatgagggttcgc

SEQ ID NO: 59463 - DNA, 15 bp, Homo sapiens
aaatgagggttcgca

SEQ ID NO: 59464 - DNA, 15 bp, Homo sapiens
aatgagggttcgcag

SEQ ID NO: 59465 - DNA, 15 bp, Homo sapiens
atgagggttcgcagc

SEQ ID NO: 59466 - DNA, 15 bp, Homo sapiens
tgagggttcgcagct

SEQ ID NO: 59467 - DNA, 15 bp, Homo sapiens
gagggttcgcagctg

SEQ ID NO: 59468 - DNA, 15 bp, Homo sapiens
agggttcgcagctgc

SEQ ID NO: 59469 - DNA, 15 bp, Homo sapiens
gggttcgcagctgcc

SEQ ID NO: 59470 - DNA, 15 bp, Homo sapiens
ggttcgcagctgcca

SEQ ID NO: 59471 - DNA, 15 bp, Homo sapiens
gttcgcagctgccag

SEQ ID NO: 59472 - DNA, 15 bp, Homo sapiens
ttcgcagctgccagg

SEQ ID NO: 59473 - DNA, 15 bp, Homo sapiens
tcgcagctgccagga

SEQ ID NO: 59474 - DNA, 15 bp, Homo sapiens
cgcagctgccaggag

SEQ ID NO: 59475 - DNA, 15 bp, Homo sapiens
gcagctgccaggagt

SEQ ID NO: 59476 - DNA, 15 bp, Homo sapiens
cagctgccaggagtc

SEQ ID NO: 59477 - DNA, 15 bp, Homo sapiens
agctgccaggagtca

SEQ ID NO: 59478 - DNA, 15 bp, Homo sapiens
gctgccaggagtcat

SEQ ID NO: 59479 - DNA, 15 bp, Homo sapiens
ctgccaggagtcatc

SEQ ID NO: 59480 - DNA, 15 bp, Homo sapiens
tgccaggagtcatcc

SEQ ID NO: 59481 - DNA, 15 bp, Homo sapiens
gccaggagtcatccc

SEQ ID NO: 59482 - DNA, 15 bp, Homo sapiens
ccaggagtcatccca

SEQ ID NO: 59483 - DNA, 15 bp, Homo sapiens
caggagtcatcccag

SEQ ID NO: 59484 - DNA, 15 bp, Homo sapiens
aggagtcatcccaga

SEQ ID NO: 59485 - DNA, 15 bp, Homo sapiens
ggagtcatcccagaa

SEQ ID NO: 59486 - DNA, 15 bp, Homo sapiens
gagtcatcccagaac

SEQ ID NO: 59487 - DNA, 15 bp, Homo sapiens
agtcatcccagaaca

SEQ ID NO: 59488 - DNA, 15 bp, Homo sapiens
gtcatcccagaacat

SEQ ID NO: 59489 - DNA, 15 bp, Homo sapiens
tcatcccagaacatt

SEQ ID NO: 59490 - DNA, 15 bp, Homo sapiens
catcccagaacattg

SEQ ID NO: 59491 - DNA, 15 bp, Homo sapiens
atcccagaacattgc

SEQ ID NO: 59492 - DNA, 15 bp, Homo sapiens
tcccagaacattgct

SEQ ID NO: 59493 - DNA, 15 bp, Homo sapiens
cccagaacattgcta

SEQ ID NO: 59494 - DNA, 15 bp, Homo sapiens
ccagaacattgctac

SEQ ID NO: 59495 - DNA, 15 bp, Homo sapiens
cagaacattgctact

SEQ ID NO: 59496 - DNA, 15 bp, Homo sapiens
agaacattgctactt

SEQ ID NO: 59497 - DNA, 15 bp, Homo sapiens
gaacattgctactta

SEQ ID NO: 59498 - DNA, 15 bp, Homo sapiens
aacattgctacttat

SEQ ID NO: 59499 - DNA, 15 bp, Homo sapiens
acattgctacttatt

SEQ ID NO: 59500 - DNA, 15 bp, Homo sapiens
cattgctacttattt

SEQ ID NO: 59501 - DNA, 15 bp, Homo sapiens
attgctacttattta

SEQ ID NO: 59502 - DNA, 15 bp, Homo sapiens
ttgctacttatttat

SEQ ID NO: 59503 - DNA, 15 bp, Homo sapiens
tgctacttatttatt

SEQ ID NO: 59504 - DNA, 15 bp, Homo sapiens
gctacttatttatta

SEQ ID NO: 59505 - DNA, 15 bp, Homo sapiens
ctacttatttattaa

SEQ ID NO: 59506 - DNA, 15 bp, Homo sapiens
tacttatttattaaa

SEQ ID NO: 59507 - DNA, 15 bp, Homo sapiens
acttatttattaaaa

SEQ ID NO: 59508 - DNA, 15 bp, Homo sapiens
cttatttattaaaaa

SEQ ID NO: 59509 - DNA, 15 bp, Homo sapiens
ttatttattaaaaag

SEQ ID NO: 59510 - DNA, 15 bp, Homo sapiens
tatttattaaaaagc

SEQ ID NO: 59511 - DNA, 15 bp, Homo sapiens
atttattaaaaagct

SEQ ID NO: 59512 - DNA, 15 bp, Homo sapiens
tttattaaaaagcta

SEQ ID NO: 59513 - DNA, 15 bp, Homo sapiens
ttattaaaaagctaa

SEQ ID NO: 59514 - DNA, 15 bp, Homo sapiens
tattaaaaagctaaa

SEQ ID NO: 59515 - DNA, 15 bp, Homo sapiens
attaaaaagctaaaa

SEQ ID NO: 59516 - DNA, 15 bp, Homo sapiens
ttaaaaagctaaaaa

SEQ ID NO: 59517 - DNA, 15 bp, Homo sapiens
taaaaagctaaaaac

SEQ ID NO: 59518 - DNA, 15 bp, Homo sapiens
aaaaagctaaaaact

SEQ ID NO: 59519 - DNA, 15 bp, Homo sapiens
aaaagctaaaaacta

SEQ ID NO: 59520 - DNA, 15 bp, Homo sapiens
aaagctaaaaactag

SEQ ID NO: 59521 - DNA, 15 bp, Homo sapiens
aagctaaaaactagt

SEQ ID NO: 59522 - DNA, 15 bp, Homo sapiens
agctaaaaactagtg

SEQ ID NO: 59523 - DNA, 15 bp, Homo sapiens
gctaaaaactagtga

SEQ ID NO: 59524 - DNA, 15 bp, Homo sapiens
ctaaaaactagtgaa

SEQ ID NO: 59525 - DNA, 15 bp, Homo sapiens
taaaaactagtgaaa

SEQ ID NO: 59526 - DNA, 15 bp, Homo sapiens
aaaaactagtgaaag

SEQ ID NO: 59527 - DNA, 15 bp, Homo sapiens
aaaactagtgaaagc

SEQ ID NO: 59528 - DNA, 15 bp, Homo sapiens
aaactagtgaaagca

SEQ ID NO: 59529 - DNA, 15 bp, Homo sapiens
aactagtgaaagcaa

SEQ ID NO: 59530 - DNA, 15 bp, Homo sapiens
actagtgaaagcaag

SEQ ID NO: 59531 - DNA, 15 bp, Homo sapiens
ctagtgaaagcaagt

SEQ ID NO: 59532 - DNA, 15 bp, Homo sapiens
tagtgaaagcaagta

SEQ ID NO: 59533 - DNA, 15 bp, Homo sapiens
agtgaaagcaagtaa

SEQ ID NO: 59534 - DNA, 15 bp, Homo sapiens
gtgaaagcaagtaac

SEQ ID NO: 59535 - DNA, 15 bp, Homo sapiens
tgaaagcaagtaact

SEQ ID NO: 59536 - DNA, 15 bp, Homo sapiens
gaaagcaagtaactg

SEQ ID NO: 59537 - DNA, 15 bp, Homo sapiens
aaagcaagtaactga

SEQ ID NO: 59538 - DNA, 15 bp, Homo sapiens
aagcaagtaactgaa

SEQ ID NO: 59539 - DNA, 15 bp, Homo sapiens
agcaagtaactgaac

SEQ ID NO: 59540 - DNA, 15 bp, Homo sapiens
gcaagtaactgaacc

SEQ ID NO: 59541 - DNA, 15 bp, Homo sapiens
caagtaactgaacca

SEQ ID NO: 59542 - DNA, 15 bp, Homo sapiens
aagtaactgaaccag

SEQ ID NO: 59543 - DNA, 15 bp, Homo sapiens
agtaactgaaccagt

SEQ ID NO: 59544 - DNA, 15 bp, Homo sapiens
gtaactgaaccagtg

SEQ ID NO: 59545 - DNA, 15 bp, Homo sapiens
taactgaaccagtga

SEQ ID NO: 59546 - DNA, 15 bp, Homo sapiens
aactgaaccagtgaa

SEQ ID NO: 59547 - DNA, 15 bp, Homo sapiens
actgaaccagtgaac

SEQ ID NO: 59548 - DNA, 15 bp, Homo sapiens
ctgaaccagtgaact

SEQ ID NO: 59549 - DNA, 15 bp, Homo sapiens
tgaaccagtgaactc

SEQ ID NO: 59550 - DNA, 15 bp, Homo sapiens
gaaccagtgaactct

SEQ ID NO: 59551 - DNA, 15 bp, Homo sapiens
aaccagtgaactctg

SEQ ID NO: 59552 - DNA, 15 bp, Homo sapiens
accagtgaactctgg

SEQ ID NO: 59553 - DNA, 15 bp, Homo sapiens
ccagtgaactctggg

SEQ ID NO: 59554 - DNA, 15 bp, Homo sapiens
cagtgaactctgggt

SEQ ID NO: 59555 - DNA, 15 bp, Homo sapiens
agtgaactctgggta

SEQ ID NO: 59556 - DNA, 15 bp, Homo sapiens
gtgaactctgggtat

SEQ ID NO: 59557 - DNA, 15 bp, Homo sapiens
tgaactctgggtatc

SEQ ID NO: 59558 - DNA, 15 bp, Homo sapiens
gaactctgggtatcg

SEQ ID NO: 59559 - DNA, 15 bp, Homo sapiens
aactctgggtatcga

SEQ ID NO: 59560 - DNA, 15 bp, Homo sapiens
actctgggtatcgat

SEQ ID NO: 59561 - DNA, 15 bp, Homo sapiens
ctctgggtatcgata

SEQ ID NO: 59562 - DNA, 15 bp, Homo sapiens
tctgggtatcgatag

SEQ ID NO: 59563 - DNA, 15 bp, Homo sapiens
ctgggtatcgatagg

SEQ ID NO: 59564 - DNA, 15 bp, Homo sapiens
tgggtatcgataggt

SEQ ID NO: 59565 - DNA, 15 bp, Homo sapiens
gggtatcgataggtt

SEQ ID NO: 59566 - DNA, 15 bp, Homo sapiens
ggtatcgataggttc

SEQ ID NO: 59567 - DNA, 15 bp, Homo sapiens
gtatcgataggttcg

SEQ ID NO: 59568 - DNA, 15 bp, Homo sapiens
tatcgataggttcgt

SEQ ID NO: 59569 - DNA, 15 bp, Homo sapiens
atcgataggttcgtc

SEQ ID NO: 59570 - DNA, 15 bp, Homo sapiens
tcgataggttcgtct

SEQ ID NO: 59571 - DNA, 15 bp, Homo sapiens
cgataggttcgtctt

SEQ ID NO: 59572 - DNA, 15 bp, Homo sapiens
gataggttcgtctta

SEQ ID NO: 59573 - DNA, 15 bp, Homo sapiens
ataggttcgtcttaa

SEQ ID NO: 59574 - DNA, 15 bp, Homo sapiens
taggttcgtcttaaa

SEQ ID NO: 59575 - DNA, 15 bp, Homo sapiens
aggttcgtcttaaat

SEQ ID NO: 59576 - DNA, 15 bp, Homo sapiens
ggttcgtcttaaata

SEQ ID NO: 59577 - DNA, 15 bp, Homo sapiens
gttcgtcttaaatag

SEQ ID NO: 59578 - DNA, 15 bp, Homo sapiens
ttcgtcttaaatagg

SEQ ID NO: 59579 - DNA, 15 bp, Homo sapiens
tcgtcttaaataggc

SEQ ID NO: 59580 - DNA, 15 bp, Homo sapiens
cgtcttaaataggcc

SEQ ID NO: 59581 - DNA, 15 bp, Homo sapiens
gtcttaaataggcca

SEQ ID NO: 59582 - DNA, 15 bp, Homo sapiens
tcttaaataggccac

SEQ ID NO: 59583 - DNA, 15 bp, Homo sapiens
cttaaataggccact

SEQ ID NO: 59584 - DNA, 15 bp, Homo sapiens
ttaaataggccactt

SEQ ID NO: 59585 - DNA, 15 bp, Homo sapiens
taaataggccacttc

SEQ ID NO: 59586 - DNA, 15 bp, Homo sapiens
aaataggccacttcc

SEQ ID NO: 59587 - DNA, 15 bp, Homo sapiens
aataggccacttccc

SEQ ID NO: 59588 - DNA, 15 bp, Homo sapiens
ataggccacttcccc

SEQ ID NO: 59589 - DNA, 15 bp, Homo sapiens
taggccacttcccca

SEQ ID NO: 59590 - DNA, 15 bp, Homo sapiens
aggccacttccccac

SEQ ID NO: 59591 - DNA, 15 bp, Homo sapiens
ggccacttccccact

SEQ ID NO: 59592 - DNA, 15 bp, Homo sapiens
gccacttccccactc

SEQ ID NO: 59593 - DNA, 15 bp, Homo sapiens
ccacttccccactcc

SEQ ID NO: 59594 - DNA, 15 bp, Homo sapiens
cacttccccactccc

SEQ ID NO: 59595 - DNA, 15 bp, Homo sapiens
acttccccactcccc

SEQ ID NO: 59596 - DNA, 15 bp, Homo sapiens
cttccccactccccc

SEQ ID NO: 59597 - DNA, 15 bp, Homo sapiens
ttccccactccccca

SEQ ID NO: 59598 - DNA, 15 bp, Homo sapiens
tccccactcccccac

SEQ ID NO: 59599 - DNA, 15 bp, Homo sapiens
ccccactcccccacc

SEQ ID NO: 59600 - DNA, 15 bp, Homo sapiens
cccactcccccaccc

SEQ ID NO: 59601 - DNA, 15 bp, Homo sapiens
ccactcccccacccc

SEQ ID NO: 59602 - DNA, 15 bp, Homo sapiens
cactcccccaccccc

SEQ ID NO: 59603 - DNA, 15 bp, Homo sapiens
actcccccacccccc

SEQ ID NO: 59604 - DNA, 15 bp, Homo sapiens
ctcccccaccccccc

SEQ ID NO: 59605 - DNA, 15 bp, Homo sapiens
tcccccaccccccct

SEQ ID NO: 59606 - DNA, 15 bp, Homo sapiens
cccccaccccccctt

SEQ ID NO: 59607 - DNA, 15 bp, Homo sapiens
ccccacccccccttg

SEQ ID NO: 59608 - DNA, 15 bp, Homo sapiens
cccacccccccttgc

SEQ ID NO: 59609 - DNA, 15 bp, Homo sapiens
ccacccccccttgct

SEQ ID NO: 59610 - DNA, 15 bp, Homo sapiens
cacccccccttgctt

SEQ ID NO: 59611 - DNA, 15 bp, Homo sapiens
acccccccttgcttg

SEQ ID NO: 59612 - DNA, 15 bp, Homo sapiens
cccccccttgcttgg

SEQ ID NO: 59613 - DNA, 15 bp, Homo sapiens
ccccccttgcttggt

SEQ ID NO: 59614 - DNA, 15 bp, Homo sapiens
cccccttgcttggtc

SEQ ID NO: 59615 - DNA, 15 bp, Homo sapiens
ccccttgcttggtct

SEQ ID NO: 59616 - DNA, 15 bp, Homo sapiens
cccttgcttggtctt

SEQ ID NO: 59617 - DNA, 15 bp, Homo sapiens
ccttgcttggtcttg

SEQ ID NO: 59618 - DNA, 15 bp, Homo sapiens
cttgcttggtcttgt

SEQ ID NO: 59619 - DNA, 15 bp, Homo sapiens
ttgcttggtcttgtc

SEQ ID NO: 59620 - DNA, 15 bp, Homo sapiens
tgcttggtcttgtcc

SEQ ID NO: 59621 - DNA, 15 bp, Homo sapiens
gcttggtcttgtcct

SEQ ID NO: 59622 - DNA, 15 bp, Homo sapiens
cttggtcttgtcctt

SEQ ID NO: 59623 - DNA, 15 bp, Homo sapiens
ttggtcttgtccttg

SEQ ID NO: 59624 - DNA, 15 bp, Homo sapiens
tggtcttgtccttgg

SEQ ID NO: 59625 - DNA, 15 bp, Homo sapiens
ggtcttgtccttggt

SEQ ID NO: 59626 - DNA, 15 bp, Homo sapiens
gtcttgtccttggtg

SEQ ID NO: 59627 - DNA, 15 bp, Homo sapiens
tcttgtccttggtgg

SEQ ID NO: 59628 - DNA, 15 bp, Homo sapiens
cttgtccttggtggc

SEQ ID NO: 59629 - DNA, 15 bp, Homo sapiens
ttgtccttggtggct

SEQ ID NO: 59630 - DNA, 15 bp, Homo sapiens
tgtccttggtggcta

SEQ ID NO: 59631 - DNA, 15 bp, Homo sapiens
gtccttggtggctaa

SEQ ID NO: 59632 - DNA, 15 bp, Homo sapiens
tccttggtggctaag

SEQ ID NO: 59633 - DNA, 15 bp, Homo sapiens
ccttggtggctaaga

SEQ ID NO: 59634 - DNA, 15 bp, Homo sapiens
cttggtggctaagac

SEQ ID NO: 59635 - DNA, 15 bp, Homo sapiens
ttggtggctaagact

SEQ ID NO: 59636 - DNA, 15 bp, Homo sapiens
tggtggctaagactt

SEQ ID NO: 59637 - DNA, 15 bp, Homo sapiens
ggtggctaagactta

SEQ ID NO: 59638 - DNA, 15 bp, Homo sapiens
gtggctaagacttag

SEQ ID NO: 59639 - DNA, 15 bp, Homo sapiens
tggctaagacttagc

SEQ ID NO: 59640 - DNA, 15 bp, Homo sapiens
ggctaagacttagct

SEQ ID NO: 59641 - DNA, 15 bp, Homo sapiens
gctaagacttagctc

SEQ ID NO: 59642 - DNA, 15 bp, Homo sapiens
ctaagacttagctct

SEQ ID NO: 59643 - DNA, 15 bp, Homo sapiens
taagacttagctctg

SEQ ID NO: 59644 - DNA, 15 bp, Homo sapiens
aagacttagctctgc

SEQ ID NO: 59645 - DNA, 15 bp, Homo sapiens
agacttagctctgca

SEQ ID NO: 59646 - DNA, 15 bp, Homo sapiens
gacttagctctgcag

SEQ ID NO: 59647 - DNA, 15 bp, Homo sapiens
acttagctctgcagg

SEQ ID NO: 59648 - DNA, 15 bp, Homo sapiens
cttagctctgcaggg

SEQ ID NO: 59649 - DNA, 15 bp, Homo sapiens
ttagctctgcagggg

SEQ ID NO: 59650 - DNA, 15 bp, Homo sapiens
tagctctgcagggga

SEQ ID NO: 59651 - DNA, 15 bp, Homo sapiens
agctctgcaggggat

SEQ ID NO: 59652 - DNA, 15 bp, Homo sapiens
gctctgcaggggatg

SEQ ID NO: 59653 - DNA, 15 bp, Homo sapiens
ctctgcaggggatgt

SEQ ID NO: 59654 - DNA, 15 bp, Homo sapiens
tctgcaggggatgtt

SEQ ID NO: 59655 - DNA, 15 bp, Homo sapiens
ctgcaggggatgtta

SEQ ID NO: 59656 - DNA, 15 bp, Homo sapiens
tgcaggggatgttaa

SEQ ID NO: 59657 - DNA, 15 bp, Homo sapiens
gcaggggatgttaaa

SEQ ID NO: 59658 - DNA, 15 bp, Homo sapiens
caggggatgttaaag

SEQ ID NO: 59659 - DNA, 15 bp, Homo sapiens
aggggatgttaaagc

SEQ ID NO: 59660 - DNA, 15 bp, Homo sapiens
ggggatgttaaagca

SEQ ID NO: 59661 - DNA, 15 bp, Homo sapiens
gggatgttaaagcac

SEQ ID NO: 59662 - DNA, 15 bp, Homo sapiens
ggatgttaaagcaca

SEQ ID NO: 59663 - DNA, 15 bp, Homo sapiens
gatgttaaagcacag

SEQ ID NO: 59664 - DNA, 15 bp, Homo sapiens
atgttaaagcacagt

SEQ ID NO: 59665 - DNA, 15 bp, Homo sapiens
tgttaaagcacagtt

SEQ ID NO: 59666 - DNA, 15 bp, Homo sapiens
gttaaagcacagtta

SEQ ID NO: 59667 - DNA, 15 bp, Homo sapiens
ttaaagcacagttag

SEQ ID NO: 59668 - DNA, 15 bp, Homo sapiens
taaagcacagttagt

SEQ ID NO: 59669 - DNA, 15 bp, Homo sapiens
aaagcacagttagta

SEQ ID NO: 59670 - DNA, 15 bp, Homo sapiens
aagcacagttagtag

SEQ ID NO: 59671 - DNA, 15 bp, Homo sapiens
agcacagttagtagg

SEQ ID NO: 59672 - DNA, 15 bp, Homo sapiens
gcacagttagtagga

SEQ ID NO: 59673 - DNA, 15 bp, Homo sapiens
cacagttagtaggac

SEQ ID NO: 59674 - DNA, 15 bp, Homo sapiens
acagttagtaggacg

SEQ ID NO: 59675 - DNA, 15 bp, Homo sapiens
cagttagtaggacgt

SEQ ID NO: 59676 - DNA, 15 bp, Homo sapiens
agttagtaggacgtg

SEQ ID NO: 59677 - DNA, 15 bp, Homo sapiens
gttagtaggacgtgg

SEQ ID NO: 59678 - DNA, 15 bp, Homo sapiens
ttagtaggacgtggc

SEQ ID NO: 59679 - DNA, 15 bp, Homo sapiens
tagtaggacgtggct

SEQ ID NO: 59680 - DNA, 15 bp, Homo sapiens
agtaggacgtggctc

SEQ ID NO: 59681 - DNA, 15 bp, Homo sapiens
gtaggacgtggctct

SEQ ID NO: 59682 - DNA, 15 bp, Homo sapiens
taggacgtggctctg

SEQ ID NO: 59683 - DNA, 15 bp, Homo sapiens
aggacgtggctctgc

SEQ ID NO: 59684 - DNA, 15 bp, Homo sapiens
ggacgtggctctgca

SEQ ID NO: 59685 - DNA, 15 bp, Homo sapiens
gacgtggctctgcac

SEQ ID NO: 59686 - DNA, 15 bp, Homo sapiens
acgtggctctgcaca

SEQ ID NO: 59687 - DNA, 15 bp, Homo sapiens
cgtggctctgcacag

SEQ ID NO: 59688 - DNA, 15 bp, Homo sapiens
gtggctctgcacagc

SEQ ID NO: 59689 - DNA, 15 bp, Homo sapiens
tggctctgcacagcc

SEQ ID NO: 59690 - DNA, 15 bp, Homo sapiens
ggctctgcacagccc

SEQ ID NO: 59691 - DNA, 15 bp, Homo sapiens
gctctgcacagccca

SEQ ID NO: 59692 - DNA, 15 bp, Homo sapiens
ctctgcacagcccaa

SEQ ID NO: 59693 - DNA, 15 bp, Homo sapiens
tctgcacagcccaaa

SEQ ID NO: 59694 - DNA, 15 bp, Homo sapiens
ctgcacagcccaaaa

SEQ ID NO: 59695 - DNA, 15 bp, Homo sapiens
tgcacagcccaaaaa

SEQ ID NO: 59696 - DNA, 15 bp, Homo sapiens
gcacagcccaaaaac

SEQ ID NO: 59697 - DNA, 15 bp, Homo sapiens
cacagcccaaaaacc

SEQ ID NO: 59698 - DNA, 15 bp, Homo sapiens
acagcccaaaaacca

SEQ ID NO: 59699 - DNA, 15 bp, Homo sapiens
cagcccaaaaaccag

SEQ ID NO: 59700 - DNA, 15 bp, Homo sapiens
agcccaaaaaccagc

SEQ ID NO: 59701 - DNA, 15 bp, Homo sapiens
gcccaaaaaccagct

SEQ ID NO: 59702 - DNA, 15 bp, Homo sapiens
cccaaaaaccagctt

SEQ ID NO: 59703 - DNA, 15 bp, Homo sapiens
ccaaaaaccagctta

SEQ ID NO: 59704 - DNA, 15 bp, Homo sapiens
caaaaaccagcttac

SEQ ID NO: 59705 - DNA, 15 bp, Homo sapiens
aaaaaccagcttact

SEQ ID NO: 59706 - DNA, 15 bp, Homo sapiens
aaaaccagcttactc

SEQ ID NO: 59707 - DNA, 15 bp, Homo sapiens
aaaccagcttactcc

SEQ ID NO: 59708 - DNA, 15 bp, Homo sapiens
aaccagcttactcct

SEQ ID NO: 59709 - DNA, 15 bp, Homo sapiens
accagcttactcctt

SEQ ID NO: 59710 - DNA, 15 bp, Homo sapiens
ccagcttactcctta

SEQ ID NO: 59711 - DNA, 15 bp, Homo sapiens
cagcttactccttag

SEQ ID NO: 59712 - DNA, 15 bp, Homo sapiens
agcttactccttagc

SEQ ID NO: 59713 - DNA, 15 bp, Homo sapiens
gcttactccttagcc

SEQ ID NO: 59714 - DNA, 15 bp, Homo sapiens
cttactccttagcca

SEQ ID NO: 59715 - DNA, 15 bp, Homo sapiens
ttactccttagccag

SEQ ID NO: 59716 - DNA, 15 bp, Homo sapiens
tactccttagccagg

SEQ ID NO: 59717 - DNA, 15 bp, Homo sapiens
actccttagccaggg

SEQ ID NO: 59718 - DNA, 15 bp, Homo sapiens
ctccttagccagggt

SEQ ID NO: 59719 - DNA, 15 bp, Homo sapiens
tccttagccagggtg

SEQ ID NO: 59720 - DNA, 15 bp, Homo sapiens
ccttagccagggtgt

SEQ ID NO: 59721 - DNA, 15 bp, Homo sapiens
cttagccagggtgtg

SEQ ID NO: 59722 - DNA, 15 bp, Homo sapiens
ttagccagggtgtga

SEQ ID NO: 59723 - DNA, 15 bp, Homo sapiens
tagccagggtgtgag

SEQ ID NO: 59724 - DNA, 15 bp, Homo sapiens
gcggtgttcccgagg

SEQ ID NO: 59725 - DNA, 15 bp, Homo sapiens
gtgttcccgaggcga

SEQ ID NO: 59726 - DNA, 15 bp, Homo sapiens
tgttcccgaggcgac

SEQ ID NO: 59727 - DNA, 15 bp, Homo sapiens
gcggcctcgatccgg

SEQ ID NO: 59728 - DNA, 15 bp, Homo sapiens
gcgtccacatgccgc

SEQ ID NO: 59729 - DNA, 15 bp, Homo sapiens
cacatgccgcggcgg

SEQ ID NO: 59730 - DNA, 15 bp, Homo sapiens
ggcagcggccgataa

SEQ ID NO: 59731 - DNA, 15 bp, Homo sapiens
agcggccgataaatg

SEQ ID NO: 59732 - DNA, 15 bp, Homo sapiens
cggccgataaatgct

SEQ ID NO: 59733 - DNA, 15 bp, Homo sapiens
gagccgtccccgacg

SEQ ID NO: 59734 - DNA, 15 bp, Homo sapiens
ccatggagaacgcgc

SEQ ID NO: 59735 - DNA, 15 bp, Homo sapiens
cttcggcgtcaacga

SEQ ID NO: 59736 - DNA, 15 bp, Homo sapiens
ttcggcgtcaacgag

SEQ ID NO: 59737 - DNA, 15 bp, Homo sapiens
gtcaacgagagtacg

SEQ ID NO: 59738 - DNA, 15 bp, Homo sapiens
tcaacgagagtacgg

SEQ ID NO: 59739 - DNA, 15 bp, Homo sapiens
ggctccaacggtagg
